US010746735B2

(12) United States Patent
Lüking et al.

(10) Patent No.: US 10,746,735 B2
(45) Date of Patent: Aug. 18, 2020

(54) MARKER SEQUENCES FOR DIAGNOSING AND STRATIFYING SLE PATIENTS

(71) Applicant: PROTAGEN AG, Dortmund (DE)

(72) Inventors: Angelika Lüking, Bochum (DE); Peter Schulz-Knappe, Hemmingen (DE); Carmen Theek, Herdecke (DE); Petra Budde, Dortmund (DE); Anna Telaar, Dortmund (DE)

(73) Assignee: Oncimmune Germany GmbH, Dortmund (DE)

( * ) Notice: Subject to any disclaimer, the term of this patent is extended or adjusted under 35 U.S.C. 154(b) by 198 days.

(21) Appl. No.: 15/117,508

(22) PCT Filed: Feb. 10, 2015

(86) PCT No.: PCT/EP2015/052805
§ 371 (c)(1),
(2) Date: Aug. 9, 2016

(87) PCT Pub. No.: WO2015/118184
PCT Pub. Date: Aug. 13, 2015

(65) Prior Publication Data
US 2017/0074875 A1 Mar. 16, 2017

(30) Foreign Application Priority Data

Feb. 10, 2014 (EP) .................................... 14154557
Jul. 22, 2014 (EP) .................................... 14178090

(51) Int. Cl.
*G01N 33/564* (2006.01)

(52) U.S. Cl.
CPC ....... *G01N 33/564* (2013.01); *G01N 2500/04* (2013.01); *G01N 2800/104* (2013.01); *G01N 2800/52* (2013.01)

(58) Field of Classification Search
None
See application file for complete search history.

(56) References Cited

U.S. PATENT DOCUMENTS

2013/0303395 A1   11/2013   Lueking et al.

FOREIGN PATENT DOCUMENTS

| EP | 2 441 848 A1 | 4/2012 |
|---|---|---|
| WO | WO-99/57311 A2 | 11/1999 |
| WO | WO-99/57312 A1 | 11/1999 |
| WO | WO-2008/109030 A2 | 9/2008 |
| WO | WO-2012/049225 A2 | 4/2012 |
| WO | WO-2014/020357 A1 | 2/2014 |

OTHER PUBLICATIONS

AKO57299 Deposit information (Year: 2008).*
Collins et al. Pro Natl. Acad. Sci. USA 2002 vol. 99, p. 16899-16903 (Year: 2002).*
Ota et al. (Nat. Genet. 2004 vol. 36, p. 40-45) (Year: 2004).*
Vanarsa F1000 Medicine Reports vol. 2, p. 87; total 5 pages (Year: 2010).*
Kuno J Biol. Chem ; 1993, vol. 268, p. 13510-13518 (Year: 1993).*
Ashmun Blood 1992, vol. 79, page 3344-3349 (Year: 1992).*
Green Pro. Natl. Acad. Sci. 1999 vol. 96, p. 4176-4179 (Year: 1999).*
Erlenbach J. Biol. Chem 2001 vol. 276, p. 29382-39392 (Year: 2001).*
Noutoshi The Plant Journal ; 2005 vol. 43, p. 873-888 (Year: 2005).*
Bowie Science, 1990 vol. 247:1306-1310 (Year: 1990).*
Kataoka et al. (Biochim Biophys Acta 1991 vol. 1089, 393-395) (Year: 1991).*
Godbout et al. (Gene 123 (2), 195-201 (1993)) (Year: 1993).*
Budde, P., et al., "Diagnostic Autoantibody Signatures of Rheumatoid Arthritis Patients Identified with A Bead-Based Assay Approach", Database Biosis Accession No. PREV201300781846, Abstract No. AB0746, 2013.
Budde, P., et al., "Identification of Novel Distinct Autoantigen Clusters Reflecting the Heterogeneity of Systemic Lupus Erythematosus", Database Biosis Accession No. PREV201300782499, Abstract No. 1575, 2013.
Carlsson, A., et al., "Serum Protein Profiling of Systemic Lupus Erythematosus and Systemic Sclerosis Using Recombinant Antibody Microarrays", Molecular & Cellular Proteomics, 2011, vol. 10, No. 5, 10.1074/mcp.M110.005033-13, 14 pages.
Ching, K. H., et al., "Two Major Autoantibody Clusters in Systemic Lupus Erythematosus", PLoS One, 2012, vol. 7, Issue 2, p. e32001, 11 pages.
Gutjahr,m C., et al., "Mouse Protein Arrays from a $T_H1$ Cell cDNA Library for Antibody Screening and Serum Profiling", Genomics, 2005, vol. 85, pp. 285-296.
Liu, C.-C., et al., "Biomarkers in Systemic Lupus Erythematosus: Challenges and Prospects for the Future", Therapeutic Advances in Musculoskeletal Disease, 2013, vol. 5, No. 4, pp. 210-233.
Lueking, A., et al., "Autoantibody Signatures of Systemic Lupus Erythematosus (SLE) Patients Identified with a Bead-Based Assay Approach", Database Biosis Accession No. PREV201400263908, 2014, Abstract No. [2013][FRI0473] (Published in Ann. Rheum. Dis., 2013, vol. 72(Suppl3), p. 535).

(Continued)

*Primary Examiner* — Changhwa J Cheu
(74) *Attorney, Agent, or Firm* — Finnegan, Henderson, Farabow, Garrett and Dunner, LLP

(57) ABSTRACT

The present invention relates to methods for identifying markers for systemic lupus erythematosus (SLE) and to the markers identified with the aid of this method, which can differentiate between SLE and other autoimmune diseases on the one hand and between different SLE subgroups on the other hand. The invention also relates to panels, diagnostic devices and test kits which comprise these markers, and to the use and application thereof, for example for the diagnosis, prognosis and therapy control in SLE. The invention also relates to methods for screening and validating active substances for application in SLE subgroups.

4 Claims, 13 Drawing Sheets
Specification includes a Sequence Listing.

(56) References Cited

OTHER PUBLICATIONS

Mattoon, D., et al., "Sa.27. Discovery of SLE Autoantibody Biomarkers Utilizing Protein Microarray Technology", Clinical Immunology, 2008, vol. 127, p. S89.
Sherer, Y., et al., "Autoantibody Explosion in Systemic Lupus Erythematosus: More than 100 Different Antibodies Found in SLE Patients", Seminars in Arthritis and Rheumatism, 2004, vol. 34, No. 2, pp. 501-537.
International Preliminary Report on Patentability for PCT/EP2015/052805 dated Aug. 16, 2016 with English Translation Attached.
International Search Report for PCT/EP2015/052805 dated May 15, 2015.

* cited by examiner a) Dendogram of the known ENA-4 antigens b) Dendogram of 50 selected SLE antigens a) SLE cohort I B) SLE cohort II C) SLE cohort III

MARKER SEQUENCES FOR DIAGNOSING AND STRATIFYING SLE PATIENTS

RELATED APPLICATIONS

This application is a national stage application (under 35 U.S.C. § 371) of PCT/EP2015/052805, filed Feb. 10, 2015, which claims benefit of European Application No. 14154557.4, filed Feb. 10, 2014, and European Application No. 14178090.8, filed Jul. 22, 2014.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence Listing_074027_0034. The size of the text file is 6,394 KB, and the text file was created on Nov. 30, 2016.

The present invention relates to methods for identifying markers for systemic lupus erythematosus (SLE) and to the markers identified with the aid of this method, which can differentiate between SLE and other autoimmune diseases on the one hand and between different SLE subgroups on the other hand. The invention also relates to panels of markers for SLE, diagnostic devices and test kits for SLE which comprise these markers, and to the use and application thereof, for example for the diagnosis, prognosis and therapy control of SLE. The invention also relates to methods for screening and for validating active substances for application in SLE subgroups.

Systemic lupus erythematosus (SLE) is a rare autoimmune disease. In the case of lupus erythematosus the body's own immune system is disregulated. It not only attacks bacteria, viruses and cancer cells, but also healthy body cells. Organs and organ systems, for example the skin, are damaged as a result.

In clinical practice, SLE is diagnosed on the basis of a combination of clinical and immunological parameters. Here, antinuclear autoantibodies (ANAs) and anti-double-stranded DNA (anti-dsDNA) autoantibodies play a key role. However, the ANA test is not specific for SLE, since other autoimmune diseases and up to 20% of healthy individuals are also positively tested. The autoreactivity against extractable nuclear antigens (ENAs) as recombinant or purified individual antigens is therefore increasingly tested, for example against Sm-protein, U1-RNP, Rho52/SS-A and Ro60/SS-B. These antigens and associated autoantibodies, however, are not sufficient for diagnosing all SLE patients without doubt, in particular in an early phase of the disease. By way of example, anti-dsDNA antibodies are indeed highly specific for SLE and can be detected in approximately 70% of patients. However, the titre of the anti-dsDNA antibodies correlates with the disease activity in some patients, but not in all patients. As a result, SLE is often only diagnosed months or years after the occurrence of the first symptoms. A further problem of the currently used diagnostic methods is that the suitability of the previously tested autoantigens for the diagnosis of organ involvement and complications is disputed, and partly conflicting data has been published.

There is thus a great need to provide new markers for the diagnosis and differential diagnosis of SLE.

Marker sequences for the diagnosis of SLE are disclosed in WO 2012/049225 A2. These marker sequences were discovered by a method in which serum samples of SLE patients and those of healthy individuals were examined by comparison and the results were statistically evaluated. The marker sequences described in WO 2012/049225 A2, however, are not sufficiently suitable for the diagnosis of SLE with regard to a distinction from other autoimmune diseases and the identification of SLE subgroups.

There is therefore still a need for markers for SLE, in particular for the distinction of SLE from other autoimmune diseases.

This object has been achieved in accordance with the invention in that a differential method comprising a multiplicity of steps has been developed, in which serum samples of healthy individuals and patients with various autoimmune diseases were examined by comparison with regard to their reactivity with a multiplicity of potential antigens and these results were statistically evaluated. The selection of the serum samples and the sequence of the steps surprisingly made it possible to identify highly specific markers for SLE which are also suitable for identifying SLE subgroups and complications such as lupus nephritis and for providing a differential diagnosis in respect of other autoimmune diseases, such as rheumatoid arthritis (RA), systemic sclerosis (SSc), ankylosing spondylitis or Bekhterev's disease (SPA), and also in respect of individuals who have early RA, i.e. have been suffering with the disease for less than two years ("patients with early RA").

The present invention relates to a method for identifying markers for systemic lupus erythematosus (SLE) comprising the following steps a) bringing serum samples of SLE patients into contact with more than 5000 antigens coupled to (Luminex) beads, measuring the binding of the individual antigens to proteins, in particular autoantibodies, in the serum of the SLE patients by means of immunofluorescence assay, and determining the median fluorescence intensity (MFI) for each individual antigen;

b) bringing serum samples of patients with rheumatoid arthritis (RA) into contact with the same antigens coupled to (Luminex) beads, measuring the binding of the individual antigens to proteins, in particular autoantibodies, in the serum of the RA patients by means of immunofluorescence assay, and determining from this the median fluorescence intensity (MFI) for each individual antigen;

c) bringing serum samples of healthy individuals into contact with the same antigens coupled to (Luminex) beads, measuring the binding of the individual antigens to proteins, in particular autoantibodies, in the serum of the healthy individuals by means of immunofluorescence assay, and determining from this the median fluorescence intensity (MFI) for each individual antigen;

d) statistically evaluating the MFI data from a), b) and c) by means of univariate analysis and thus identifying marker candidate antigens with which SLE patients can be differentiated from RA patients and from healthy individuals;

e) bringing serum samples of patients with early RA into contact with the marker candidate antigens identified in d) coupled to (Luminex) beads, measuring the binding of marker candidate antigens to proteins, in particular autoantibodies, in the serum of patients with early RA by means of immunofluorescence assay, and determining from this the median fluorescence intensity (MFI) for each marker candidate antigen;

f) bringing serum samples of patients with systemic sclerosis (SSc patients) into contact with the marker candidate antigens identified in d) coupled to (Luminex) beads, measuring the binding of marker candidate antigens to proteins, in particular autoantibodies, in the serum of SSc patients by immunofluorescence assay, and determining from this the median fluorescence intensity (MFI) for each marker candidate;

g) bringing serum samples of patients with ankylosing spondylitis or Bekhterev's disease (SPA patients) into contact with the marker candidate antigens identified in d) coupled to (Luminex) beads, measuring the binding of marker candidate antigens to proteins, in particular autoantibodies, in the serum of SPA patients by means of immunofluorescence assay, and determining from this the median fluorescence intensity (MFI) for each marker candidate antigen;

h) statistically evaluating the MFI data from e), f) and g) by means of univariate analysis and, when a threshold value of 3 standard deviations above the mean value of the healthy samples is not reached, identifying a specific marker for SLE, wherein the markers are selected from sequences SEQ ID No. 1 to 1584, homologues of sequences SEQ ID No. 1 to 1584 with at least 95% homology, subsequences of SEQ ID No. 1 to 1584, subsequences of homologues of SEQ ID No. 1 to 1584 with at least 95% homology.

The term "systemic lupus erythematosus (SLE) relates to a systemic autoimmune disease from the group of collagenoses. What is known as the butterfly rash is particularly characteristic for SLE (systemic lupus erythematosus). The diagnosis criteria for SLE are:

1. butterfly rash, 2. discoid skin changes, 3. sensitivity to light, 4. mucous membrane ulcers (generally painless), 5. arthritis in at least two joints, 6. serositis (pleurisy or pericarditis), 7. kidney involvement (proteinuria >0.5 g/d or cylinder), 8. CNS involvement (cramps or psychosis), 9. haematological findings (haemolytic anaemia, leucopenia or thrombopenia), 10. immunological findings (anti-dsDNA antibodies, anti-Sm antibodies, anticardiolipin antibodies), 11. antinuclear antibodies without taking lupus erythematosus-triggering medication.

Evaluation: With four (three) positive findings, the diagnosis is considered reliable (likely) (definition for example according to Pschyrembel, de Gruyter, 261$^{st}$ edition (2007), Berlin).

One embodiment of the invention relates to methods for identifying markers for SLE which are suitable for the diagnosis and differential diagnosis of SLE, in particular for distinction from other autoimmune diseases, preferably for distinction from other rheumatic diseases, particularly preferably for distinction from RA, SSc, and SPA. These markers are also suitable for distinction from patients with early RA. These markers for SLE according to the invention are the subject of group 1 of antigens in Table 2, which can be used for the diagnosis of SLE. For the generation of these markers, marker candidate antigens which have an adjusted p-value for the non-parametric mean value comparison between groups of <0.05 and at the same time a fold change of >1.5 and additionally an AUC resulting from the ROC analysis of >0.75 are selected on the basis of the univariate results. In addition, the ENA-4 antigens are selected. For this pool of selected marker candidate antigens, an L1-penalised logistic regression model is preferably also established within the scope of a nested cross validation. Marker candidate antigens which are not considered within the scope of the creation of the model are removed from the further consideration. The markers for SLE are thus obtained, selected from the sequences (group 1)

SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426, homologues of SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426 with at least 95% homology, subsequences of SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426 and subsequences of homologues of SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426 with at least 95% homology.

Another embodiment relates to methods for identifying markers for the subgroup of SLE patients with the complication lupus nephritis, comprising the comparison of the autoantibody profiles of SLE patients with lupus nephritis with those of SLE patients without lupus nephritis. Markers which are found by means of this embodiment of the method are specified for example in Table 2, in group 2 and group 5. These are methods for example in which the markers for the subgroup of the SLE patients with the complication lupus nephritis are selected from the sequences SEQ ID No. 25 to 54, 214, 215, 216, 217, 227, 232, 240, 244, 246, 248, 257, 287, 288, 300, 308, 314, 315, 323, 329, 330, 336, 338, 347, 349, 358, 361, 362, SEQ ID No. 552 to 581, 742, 743, 744, 745, 755, 760, 768, 772, 774, 776, 785, 815, 816, 828, 836, 842, 843, 851, 857, 858, 864, 866, 875, 877, 886, 889, 890 and SEQ ID No. 1081 to 1110, 1271, 1272, 1273, 1274, 1284, 1289, 1297, 1301, 1303, 1305, 1314, 1344, 1345, 1357, 1365, 1371, 1372, 1380, 1386, 1387, 1393, 1395, 1404, 1406, 1415, 1418, 1419, homologues of SEQ ID No. 25 to 54, 214, 215, 216, 217, 227, 232, 240, 244, 246, 248, 257, 287, 288, 300, 308, 314, 315, 323, 329, 330, 336, 338, 347, 349, 358, 361, 362, SEQ ID No. 552 to 581, 742, 743, 744, 745, 755, 760, 768, 772, 774, 776, 785, 815, 816, 828, 836, 842, 843, 851, 857, 858, 864, 866, 875, 877, 886, 889, 890 and SEQ ID No. 1081 to 1110, 1271, 1272, 1273, 1274, 1284, 1289, 1297, 1301, 1303, 1305, 1314, 1344, 1345, 1357, 1365, 1371, 1372, 1380, 1386, 1387, 1393, 1395, 1404, 1406, 1415, 1418, 1419 with at least 95% homology, subsequences of SEQ ID No. 25 to 54, 214, 215, 216, 217, 227, 232, 240, 244, 246, 248, 257, 287, 288, 300, 308, 314, 315, 323, 329, 330, 336, 338, 347, 349, 358, 361, 362, SEQ ID No. 552 to 581, 742, 743, 744, 745, 755, 760, 768, 772, 774, 776, 785, 815, 816, 828, 836, 842, 843, 851, 857, 858, 864, 866, 875, 877, 886, 889, 890 and SEQ ID No. 1081 to 1110, 1271, 1272, 1273, 1274, 1284, 1289, 1297, 1301, 1303, 1305, 1314, 1344, 1345, 1357, 1365, 1371, 1372, 1380, 1386, 1387, 1393, 1395, 1404, 1406, 1415, 1418, 1419 and subsequences of homologues of SEQ ID No. 25 to 54, 214, 215, 216, 217, 227, 232, 240, 244, 246, 248, 257, 287, 288, 300, 308, 314, 315, 323, 329, 330, 336, 338, 347, 349, 358, 361, 362, SEQ ID No. 552 to 581, 742, 743, 744, 745, 755, 760, 768, 772, 774, 776, 785, 815, 816, 828, 836, 842, 843, 851, 857, 858, 864, 866, 875, 877, 886, 889, 890 and SEQ ID No. 1081 to 1110, 1271, 1272, 1273, 1274, 1284, 1289, 1297, 1301, 1303, 1305, 1314, 1344, 1345, 1357, 1365, 1371, 1372, 1380, 1386, 1387, 1393, 1395, 1404, 1406, 1415, 1418, 1419 with at least 95% homology.

A further embodiment relates to methods which comprise the statistical evaluation by means of an L1-penalised logistic regression model with five-fold cross validation and twenty times repetition and selection of the markers which occur at a frequency of 50% or more. Markers which can be identified by means of this embodiment of the method are specified for example in Table 2, group 2. These are methods for example in which the markers for the subgroup of the SLE patients with the complication lupus nephritis are selected from the sequences SEQ ID No. 25 to 54, SEQ ID No. 552 to 581 and SEQ ID No. 1081 to 1110, homologues of 25 to 54, SEQ ID No. 552 to 581 and SEQ ID No. 1081 to 1110 with at least 95% homology, subsequences of SEQ ID No. 25 to 54, SEQ ID No. 552 to 581 and SEQ ID No. 1081 to 1110 and subsequences of homologues of SEQ ID No. 25 to 54, SEQ ID No. 552 to 581 and SEQ ID No. 1081 to 1110 with at least 95% homology.

In a further embodiment of the method, markers for defined subgroups of SLE patients are identified in that the sequences SEQ ID No. 1 to 527 (clone sequences) are correlated with one of the sequences SEQ ID No. 1 to 527 by calculation of the Spearman's rank correlation coefficient for the particular marker. In this way, the markers of groups 1, 2 and 3 in Table 2 can be identified with the method according to the invention, for example. These are methods for example in which the markers which demonstrate a correlation with one another of the reactivities in SLE patients are selected from the sequences (group 3)

SEQ ID No. 55 to 111, SEQ ID No. 582 to 1005 and SEQ ID No. 1111 to 1167, homologues of SEQ ID No. 55 to 111, SEQ ID No. 582 to 1005 and SEQ ID No. 1111 to 1167 with at least 95% homology, subsequences of SEQ ID No. 55 to 111, SEQ ID No. 582 to 1005 and SEQ ID No. 1111 to 1167 and subsequences of homologues of SEQ ID No. 55 to 111, SEQ ID No. 582 to 1005 and SEQ ID No. 1111 to 1167 with at least 95% homology and from the sequences (group 2)

SEQ ID No. 25 to 54, SEQ ID No. 552 to 581 and SEQ ID No. 1081 to 1110, homologues of SEQ ID No. 25 to 54, SEQ ID No. 552 to 581 and SEQ ID No. 1081 to 1110 with at least 95% homology, subsequences of SEQ ID No. 25 to 54, SEQ ID No. 552 to 581 and SEQ ID No. 1081 to 1110 and subsequences of homologues of SEQ ID No. 25 to 54, SEQ ID No. 552 to 581 and SEQ ID No. 1081 to 1110 with at least 95% homology and from the sequences (group 1)

SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426, homologues of SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426 with at least 95% homology, subsequences of SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426 and subsequences of homologues of SEQ ID No. 1 to 24, 134, 168, 213, 367 to 369 SEQ ID No. 528 to 551, 661, 695, 741, 895 to 897 and SEQ ID No. 1057 to 1080, 1190, 1224, 1270, 1424 to 1426 with at least 95% homology.

One embodiment of the invention relates to methods for identifying markers for the subgroup of ENA-4-negative SLE patients. This embodiment of the method for example comprises the testing of the serum samples of SLE patients for the absence of autoantibodies against the extractable nuclear antigens Sm-protein, U1-RNP, Rho52/SS-A and Ro60/SS-B. By way of example, the markers of group 4, Table 2 can thus be identified. These are methods for example in which the markers for ENA-4-negative SLE patients are selected from the sequences (group 4)

SEQ ID No. 112 to 213 and 278, SEQ ID No. 639 to 741 and 806 and SEQ ID No. 1168 to 1270 and 1335, homologues of SEQ ID No. 112 to 213 and 278, SEQ ID No. 639 to 741 and 806 and SEQ ID No. 1168 to 1270 and 1335 with at least 95% homology, subsequences of SEQ ID No. 112 to 213 and 278, SEQ ID No. 639 to 741 and 806 and SEQ ID No. 1168 to 1270 and 1335 and subsequences of homologues of SEQ ID No. 112 to 213 and 278, SEQ ID No. 639 to 741 and 806 and SEQ ID No. 1168 to 1270 and 1335 with at least 95% homology.

One embodiment of the invention relates to methods comprising the selection of markers which have an adjusted p-value for the non-parametric mean value comparison between groups of less than 0.05, and at the same time a fold change of greater than 1.5 and an AUC resulting from the ROC analysis of greater than 0.75. By way of example, the markers of groups 1, 4 and 6 can thus be identified. The corresponding calculations for panels of markers are specified in Table 5, in which the corresponding marker composition in the panels (arrangements) can be inferred from Table 4. These are methods for example in which the markers are selected from the sequences (group 6)

SEQ ID No. 218 to 226, 228 to 231, 233 to 239, 241, 242, 243, 245, 247, 249 to 256, 258 to 277, 279 to 286, 289 to 299, 301 to 307, 309 to 313, 316 to 322, 324 to 328, 331 to 335, 337, 339 to 346, 348, 350 to 357, 359, 360, 363 to 366,

SEQ ID No. 746 to 754, 756 to 759, 761 to 767, 769, 770, 771, 773, 775, 777 to 784, 786 to 805, 807 to 814, 817 to 827, 829 to 835, 837 to 841, 844 to 850, 851 to 855, 859 to 863, 865, 867 to 874, 876, 878 to 885, 887, 888, 891 to 894 and SEQ ID No. 1275 to 1283, 1285 to 1288, 1290 to 1296, 1298, 1299, 1300, 1302, 1304, 1306 to 1313, 1315 to 1334, 1336 to 1343, 1346 to 1356, 1358 to 1364, 1366 to 1370, 1373 to 1379, 1380 to 1384, 1388 to 1392, 1394, 1396 to 1403, 1405, 1407 to 1414, 1416, 1418, 1420 to 1423, homologues of SEQ ID No. 218 to 226, 228 to 231, 233 to 239, 241, 242, 243, 245, 247, 249 to 256, 258 to 277, 279 to 286, 289 to 299, 301 to 307, 309 to 313, 316 to 322, 324 to 328, 331 to 335, 337, 339 to 346, 348, 350 to 357, 359, 360, 363 to 366, SEQ ID No. 746 to 754, 756 to 759, 761 to 767, 769, 770, 771, 773, 775, 777 to 784, 786 to 805, 807 to 814, 817 to 827, 829 to 835, 837 to 841, 844 to 850, 851 to 855, 859 to 863, 865, 867 to 874, 876, 878 to 885, 887, 888, 891 to 894, SEQ ID No. 1275 to 1283, 1285 to 1288, 1290 to 1296, 1298, 1299, 1300, 1302, 1304, 1306 to 1313, 1315 to 1334, 1336 to 1343, 1346 to 1356, 1358 to 1364, 1366 to 1370, 1373 to 1379, 1380 to 1384, 1388 to 1392, 1394, 1396 to 1403, 1405, 1407 to 1414, 1416, 1418, 1420 to 1423 with at least 95% homology, subsequences of SEQ ID No. 218 to 226, 228 to 231, 233 to 239, 241, 242, 243, 245, 247, 249 to 256, 258 to 277, 279 to 286, 289 to 299, 301 to 307, 309 to 313, 316 to 322, 324 to 328, 331 to 335, 337, 339 to 346, 348, 350 to 357, 359, 360, 363 to 366, SEQ ID No. 746 to 754, 756 to 759, 761 to 767, 769, 770, 771, 773, 775, 777 to 784, 786 to 805, 807 to 814, 817 to 827, 829 to 835, 837 to 841, 844 to 850, 851 to 855, 859 to 863, 865, 867 to 874, 876, 878 to 885, 887, 888, 891 to 894, SEQ ID No. 1275 to 1283, 1285 to 1288, 1290 to 1296, 1298, 1299, 1300, 1302, 1304, 1306 to 1313, 1315 to 1334, 1336 to 1343, 1346 to 1356, 1358 to 1364, 1366 to 1370, 1373 to 1379, 1380 to 1384, 1388 to 1392, 1394, 1396 to 1403, 1405, 1407 to 1414, 1416, 1418, 1420 to 1423 and subsequences of homologues of SEQ ID No. 218 to 226, 228 to 231, 233 to 239, 241, 242, 243, 245, 247, 249 to 256, 258 to 277, 279 to 286, 289 to 299, 301 to 307, 309 to 313, 316 to 322, 324 to 328, 331 to 335, 337, 339 to 346, 348, 350 to 357, 359, 360, 363 to 366, SEQ ID No. 746 to 754, 756 to 759, 761 to 767, 769, 770, 771, 773, 775, 777 to 784, 786 to 805, 807 to 814, 817 to 827, 829 to 835, 837 to 841, 844 to 850, 851 to 855, 859 to 863, 865, 867 to 874, 876, 878 to 885, 887, 888, 891 to 894, SEQ ID No. 1275 to 1283, 1285 to 1288, 1290 to 1296, 1298, 1299, 1300, 1302, 1304, 1306 to 1313, 1315 to 1334, 1336 to 1343, 1346 to 1356, 1358 to 1364, 1366 to 1370, 1373 to 1379, 1380 to 1384, 1388 to 1392, 1394, 1396 to 1403, 1405, 1407 to 1414, 1416, 1418, 1420 to 1423 with at least 95% homology.

Group 7 in table 2 contains a further 85 statistically significant antigens from the methods according to the invention; these are markers selected from the sequences SEQ ID No. 367 to 450, SEQ ID No. 895 to 979, SEQ ID No. 1424 to 1507, homologues of SEQ ID No. 367 to 450, SEQ ID No. 895 to 979, SEQ ID No. 1424 to 1507 with at least 95% homology, subsequences of SEQ ID No. 367 to 450, SEQ ID No. 895 to 979, SEQ ID No. 1424 to 1507 and subsequences of homologues of SEQ ID No. 367 to 450, SEQ ID No. 895 to 979, SEQ ID No. 1424 to 1507 with at least 95% homology, which can be used for the diagnosis and differential diagnosis of SLE compared with healthy individuals and other autoimmune diseases. Antigens from group 7 were also used for the calculation of biomarker combinations.

Group 8 consists of further statistically significant antigens from the methods according to the invention; markers selected from the sequences SEQ ID No. 451 to 527, SEQ ID No. 980 to 1056, SEQ ID No. 1508 to 1584, homologues of SEQ ID No. 451 to 527, SEQ ID No. 980 to 1056, SEQ ID No. 1508 to 1584 with at least 95% homology, subsequences of SEQ ID No. 451 to 527, SEQ ID No. 980 to 1056, SEQ ID No. 1508 to 1584 and subsequences of homologues of SEQ ID No. 451 to 527, SEQ ID No. 980 to 1056, SEQ ID No. 1508 to 1584 with at least 95% homology were detected and identified for the autoantibodies in SLE patients.

The invention also relates to the individual markers for SLE identified with the method according to the invention. The method concerns markers for SLE selected from the sequences SEQ ID No. 1 to 1584, homologues of sequences SEQ ID No. 1 to 1584 with at least 95% homology, subsequences of SEQ ID No. 1 to 1584 and subsequences of homologues of SEQ ID No. 1 to 1584 with at least 95% homology. The method concerns the markers of groups 1, 2, 3, 4, 5, 6, 7, 8 in Table 2, wherein the respective groups comprise the markers of the clone sequences specified in Table 2, the corresponding RNA sequences, the corresponding protein sequences, the relevant homologues with a homology of at least 95%, and the relevant subsequences. The invention relates to a marker for SLE selected from the sequences SEQ ID No. 528 to 1056 (RNA sequences), SEQ ID No. 1057 to 1584 (protein sequences). The markers according to the invention and the associated nucleic acid sequences are presented in Table 2 (SEQ ID No. of the relevant clone sequences is specified) and can be unambiguously identified by their cited database entry, for example at www.ncbi.nlm.nih.gov/, by means of their GeneID (Table 2). The sequences SEQ ID No. 1-1584 are specified in the accompanying sequence protocol, wherein SEQ ID No. 1-527 are clone sequences (cDNA), SEQ ID No. 528-1056 are RNA sequences, and SEQ ID No. 1057-1584 are protein sequences.

The invention also relates to the proteins coded by sequences SEQ ID No. 1 to 1056, the proteins coded by homologues of the sequences SEQ ID No. 1 to 1056 with at least 95% homology to the sequences SEQ ID No. 1 to 1056, the proteins coded by subsequences of SEQ ID No. 1 to 1056, the proteins coded by homologues of the subsequences of SEQ ID No. 1 to 1056 with at least 95% homology in the subsequences. In a preferred embodiment these are the proteins SEQ ID No. 1057 to 1584, homologues of the proteins with the sequences SEQ ID No. 1057 to 1584 with at least 95% homology, subsequences of SEQ ID No. 1057 to 1584, homologues of the subsequences of SEQ ID No. 1057 to 1584 with at least 95% homology.

The invention also relates to a panel of markers (also referred to as an arrangement of markers), comprising at least two different markers for SLE which are selected independently of one another from the sequences SEQ ID No. 1 to 1584, homologues of sequences SEQ ID No. 1 to 1584 with at least 95% homology, subsequences of SEQ ID No. 1 to 1584 and subsequences of homologues of SEQ ID No. 1 to 1584 with at least 95% homology. A panel of markers for SLE can comprise 2 to 20 or more, for example 3, 4, 5, 6, 7, 8, 9, 10, 11, 12, 13, 14, 15, 16, 17, 18, 19, 20, 25, 30, 40, 50, 100 or more different markers for SLE and optionally further markers, wherein the markers of SLE are selected independently of one another from the sequences SEQ ID No. 1 to 1584, homologues of sequences SEQ ID No. 1 to 1584 with at least 95% homology, subsequences of SEQ ID No. 1 to 1584 and subsequences of homologues of SEQ ID No. 1 to 1584 with at least 95% homology, and the proteins coded by the sequences.

On account of the high clinical and serological heterogeneity of the SLE disease, it is difficult to diagnose SLE unambiguously using just one biomarker. It is therefore often necessary to combine (where possible) uncorrelated autoantigens to form what are known as panels of markers (biomarker panels for SLE). By way of example, within the scope of individualised medicine, corresponding panels of markers for SLE can be composed individually for the relevant SLE subtype (subgroup) for individual patients or patient groups. It is therefore also necessary to have available a multiplicity of potential markers for SLE in order to select suitable subgroups or subtypes of specific markers for SLE for the individual case in question. A corresponding panel can be embodied for example in the form of an arrangement, an array, or also one or more beads, preferably Luminex beads. The invention thus relates to an arrangement comprising one or more markers according to the invention, a protein array comprising one or more markers according to the invention, a bead (small ball or platelet) comprising one or more markers according to the invention. Examples of SLE panels (SLE arrangements) are given in Table 4.

The invention also relates to a diagnostic device or a test kit comprising at least one marker for SLE selected from the sequences SEQ ID No. 1 to 1584, homologues of sequences SEQ ID No. 1 to 1584 with at least 95% homology, subsequences of SEQ ID No. 1 to 1584 and subsequences of homologues of SEQ ID No. 1 to 1584 with at least 95% homology, and the proteins coded by the sequences. A corresponding diagnostic device or a corresponding test kit can also comprise a panel of markers for SLE and optionally further auxiliaries and additives.

The invention also relates to the use of one or more markers for SLE selected from sequences SEQ ID No. 1 to 1584, homologues of sequences SEQ ID No. 1 to 1584 with at least 95% homology, subsequences of SEQ ID No. 1 to 1584 and subsequences of homologues of SEQ ID No. 1 to 1584 with at least 95% homology, and the proteins coded by the sequences, a marker panel for SLE, or a diagnostic device or test kit for identifying subgroups of SLE patients, for diagnosing SLE, for differential diagnosis (i.e. for distinction from other autoimmune diseases or other rheumatic diseases), for prognosis in the case of SLE, for therapy control in the case of SLE, for active substance selection in the case of SLE, for therapy monitoring in the case of SLE, or for aftercare in the case of SLE.

The invention also relates to the use of one or more of the markers for SLE selected from the sequences SEQ ID No. 1 to 1584, homologues of sequences SEQ ID No. 1 to 1584 with at least 95% homology, subsequences of SEQ ID No. 1 to 1584 and subsequences of homologues of SEQ ID No. 1 to 1584 with at least 95% homology, and the proteins coded by the sequences for the differentiation of SLE from RA and/or other autoimmune diseases, for example SSc and/or SPA and/or RA and/or early RA.

The invention also relates to the use of one or more markers for SLE selected from the sequences SEQ ID No. 112 to 213 and 278, SEQ ID No. 639 to 741 and 806 and SEQ ID No. 1168 to 1270 and 1335, homologues of SEQ ID No. 112 to 213 and 278, SEQ ID No. 639 to 741 and 806 and SEQ ID No. 1168 to 1270 and 1335 with at least 95% homology, subsequences of SEQ ID No. 112 to 213 and 278, SEQ ID No. 639 to 741 and 806 and SEQ ID No. 1168 to 1270 and 1335 and subsequences of homologues of SEQ ID No. 112 to 213 and 278, SEQ ID No. 639 to 741 and 806 and SEQ ID No. 1168 to 1270 and 1335 with at least 95% homology, and the proteins coded by the sequences for the diagnosis of SLE in ENA-4-negative SLE patients.

The invention also relates to the use of one or more markers for SLE selected from the sequences SEQ ID No. 25 to 54, SEQ ID No. 552 to 581 and SEQ ID No. 1081 to 1110, homologues of SEQ ID No. 25 to 54, SEQ ID No. 552 to 581 and SEQ ID No. 1081 to 1110 with at least 95% homology, subsequences of SEQ ID No. 25 to 54, SEQ ID No. 552 to 581 and SEQ ID No. 1081 to 1110 and subsequences of homologues of SEQ ID No. 25 to 54, SEQ ID No. 552 to 581 and SEQ ID No. 1081 to 1110 with at least 95% homology, and the proteins coded by the sequences for the diagnosis and differential diagnosis of lupus nephritis in SLE patients. Lupus nephritis is a common and serious complication of SLE. In the case of complete failure of the kidney function, therapy with dialysis is necessary. In order to avoid long-term damage, it is therefore important to identify and treat any kidney involvement early on. This is also of particular importance for the development of active substances for SLE in general, i.e. for the development of active substances for patients with lupus nephritis. Previously, there were still no biomarkers available able to diagnose lupus nephritis in all patients.

The invention also relates to markers for SLE and lupus nephritis selected from the sequences SEQ ID No. 25 to 54, SEQ ID No. 552 to 581 and SEQ ID No. 1081 to 1110, homologues of SEQ ID No. 25 to 54, SEQ ID No. 552 to 581 and SEQ ID No. 1081 to 1110 with at least 95% homology, subsequences of SEQ ID No. 25 to 54, SEQ ID No. 552 to 581 and SEQ ID No. 1081 to 1110 and subsequences of homologues of SEQ ID No. 25 to 54, SEQ ID No. 552 to 581 and SEQ ID No. 1081 to 1110 with at least 95% homology, and the proteins coded by the sequences.

The autoantibody profiles of SLE patients with lupus nephritis were therefore compared with those without lupus nephritis. Following univariate statistical evaluation, a threshold value of p<0.05 and a 1.5 times modified reactivity compared with the control group were applied.

The invention also relates to a method for the early detection, diagnosis, differential diagnosis, prognosis, therapy control and/or after-care of SLE, in which a. at least one of the markers for SLE selected from the sequences SEQ ID No. 1 to 1584, the homologues of sequences SEQ ID No. 1 to 1584 with at least 95% homology, the subsequences of SEQ ID No. 1 to 1584 or the subsequences of homologues of SEQ ID No. 1 to 1584 with at least 95% homology, and the proteins coded by the sequences b. is brought into contact with bodily fluid or a tissue sample from an individual to be tested, and c. an interaction of the bodily fluid or of the tissue sample with the one this or more markers from a. is detected.

The invention also relates to a target for the therapy of SLE selected from the sequences SEQ ID No. 1 to 1584, the homologues of sequences SEQ ID No. 1 to 1584 with at least 95% homology, the subsequences of SEQ ID No. 1 to 1584 and the subsequences of homologues of SEQ ID No. 1 to 1584 with at least 95% homology, and the proteins coded by the sequences.

The invention also relates to a composition, in particular a pharmaceutical composition, comprising at least one of the sequences SEQ ID No. 1 to 1584, the homologues of sequences SEQ ID No. 1 to 1584 with at least 95% homology, the subsequences of SEQ ID No. 1 to 1584 or the subsequences of the homologues of SEQ ID No. 1 to 1584 with at least 95% homology, and the proteins coded by the sequences.

The invention also relates to a method for screening active substances for SLE, in which a. at least one of the markers for SLE selected from the sequences SEQ ID No. 1 to 1584, the homologues of sequences SEQ ID No. 1 to 1584 with at least 95% homology, the subsequences of SEQ ID No. 1 to 1584 or the subsequences of homologues of SEQ ID No. 1 to 1584 with at least 95% homology, and the proteins coded by the sequences b. is brought into contact with a substance to be tested, and c. an interaction of the substance with the one or more markers from a. is detected.

The large clinical heterogeneity of SLE currently constitutes a big problem both for diagnosis and for active substance development.

The identification of specific antibody signatures in SLE patient subgroups therefore constitutes an important step for the improved definition of patient groups in clinical studies.

By way of example, as presented under Example 9, specific autoantibodies for lupus nephritis could be used to recruit this subgroup for drug studies.

A large number of new active substances and therapeutic antibodies are currently undergoing clinical development: inter alia, therapeutic antibodies against cell-surface receptors of immune cells, such as anti-CD20, anti-CD22, or against pro-inflammatory cytokines, such as anti-IL6, are being developed. It is therefore now possible, due to the identification of serologically defined subgroups of SLE, to link this to a target-specific response to a drug. The invention also relates to the use of one or more markers for SLE according to the invention, of an arrangement according to the invention (panel of markers for SLE), of a protein array according to the invention, of a bead according to the invention, of a diagnostic device according to the invention, or of a test kit according to the invention for the individualised diagnosis and/or therapy in individual patients, patient groups, cohorts, population groups, variants of SLE, or stages of SLE.

The invention also relates to the use of one or more markers according to the invention for SLE, of an arrangement according to the invention (panel of markers for SLE), of a protein array according to the invention, of a bead according to the invention, of a diagnostic device according to the invention, or of a test kit according to the invention for the detection and/or determination of the amount of one or more autoantibodies associated with SLE, for example in bodily fluids such as serum, tissue or tissue samples of the patient. The invention also relates to the use of one or more markers according to the invention, of an arrangement according to the invention, of a protein array according to the invention, of a bead according to the invention, of a diagnostic device according to the invention, or of a test kit according to the invention for the analysis of autoantibody profiles of patients, in particular for the qualitative and/or quantitative analysis of autoantibodies and/or for the monitoring of changes of autoantibody profiles associated with SLE, for example in bodily fluids such as serum, tissue or tissue samples of the patient.

A particular embodiment of the invention relates to methods for the early identification and diagnosis of SLE, in which the detection of an interaction of the bodily fluid or the tissue sample with the one or more markers indicates an SLE-associated autoantibody profile of the patient or of a cohort or of a population group or of a certain course of disease (prognosis) or of a certain response to a therapy/drug. The invention therefore includes the use of at least one marker for SLE selected from the sequences SEQ ID No. 1 to 1584, the homologues of sequences SEQ ID No. 1 to 1584 with at least 95% homology, the subsequences of SEQ ID No. 1 to 1584 or the subsequences of homologues of SEQ ID No. 1 to 1584 with at least 95% homology, and the proteins coded by the sequences for the analysis of autoantibody profiles of patients, in particular for the quantitative analysis and/or for the monitoring of changes of autoantibody profiles of SLE patients.

An interaction of the bodily fluid or the tissue sample with the one or more SLE markers can be detected for example by a probe, in particular by an antibody.

In a preferred embodiment at least 2, for example 3, 4, 5, 6, 7, 8, 9, 10, preferably 15 to 20 markers for SLE or 30 to 50 or 100 or more markers are used together or in combination, either simultaneously or in succession, wherein the markers for SLE are selected independently of one another from the sequences SEQ ID No. 1 to 1584, the homologues of sequences SEQ ID No. 1 to 1584 with at least 95% homology, the subsequences of SEQ ID No. 1 to 1584 or the subsequences of homologues of SEQ ID No. 1 to 1584 with at least 95% homology, and the proteins coded by the sequences.

A particular embodiment of the invention relates to a method according to the invention, wherein the stratification or therapy control includes decisions relating to the treatment and therapy of the patient, in particular hospitalisation of the patient, use, efficacy and/or dosage of one or more drugs, a therapeutic measure, or the monitoring of the course of the disease and course of therapy, aetiology, or classification of a disease inclusive of prognosis. The invention also relates to a method for stratification, in particular for risk stratification and/or therapy control of a patient with SLE.

The stratification of the patient with SLE into new or established SLE subgroups as well as the expedient selection of patient groups for the clinical development of new therapeutic agents is also included. The term therapy control likewise includes the division of patients into responders and non-responders with regard to a therapy or course thereof.

The invention in particular also relates to the detection and determination of the amount of at least two different autoantibodies in a patient by means of the SLE markers according to the invention, wherein at least two different SLE markers are preferably used. The invention also relates to a use according to the invention of one or more SLE markers, wherein at least 2, for example 3 to 5 or 10, preferably 30 to 50, or 50 to 100 or more SLE markers or the relevant autoantibodies on or from a patient to be tested are determined.

The invention comprises the SLE markers on a solid substrate, for example a filter, a membrane, a small platelet or ball, for example a magnetic or fluorophore-labelled ball, a silicon wafer, a bead, a chip, a mass spectrometry target, or a matrix, or the like. Different materials are suitable as substrates and are known to a person skilled in the art, for example glass, metal, plastic, filter, PVDF, nitrocellulose, or nylon (for example Immobilon P Millipore, Protran Whatman, Hybond N+ Amersham).

The substrate for example can correspond to a grid with the dimensions of a microtitre plate (8-12 well strips, 96 wells, 384 wells or more), of a silicon wafer, of a chip, of a mass spectrometry target, or of a matrix.

In one embodiment of the invention markers for SLE are present in the form of clone sequences or clone(s).

The markers according to the invention can be combined, supplemented or extended with known biomarkers for SLE or biomarkers for other diseases. With a combination of this type, a proportion of markers for SLE according to the invention of preferably at least 50%, preferably 60%, and particularly preferably 70% or more is comprised.

In a preferred embodiment the use of the SLE markers and the methods according to the invention are implemented outside the human or animal body, for example the diagnosis is performed ex vivo/in vitro, preferably by means of an assay, as detailed below.

In the sense of this invention, the term "diagnosis" means the positive determination of SLE with the aid of the markers according to the invention and the assignment of the patients or symptoms thereof to the disease SLE. The term "diagnosis" includes the medical diagnosis and tests in this respect, in particular in vitro diagnosis and laboratory diagnosis, and also proteomics and nucleic acid blots. Further tests may be necessary for assurance and in order to rule out other diseases. The term "diagnosis" therefore includes in particular the differential diagnosis of SLE by means of the markers according to the invention.

In the sense of this invention, "stratification or therapy control" means that, for example, the methods according to the invention allow decisions for the treatment and therapy of the patient, whether it is the hospitalisation of the patient, the use, efficacy and/or dosage of one or more drugs, a therapeutic measure or the monitoring of the course of a disease and the course of therapy or aetiology or classification of a disease, for example into a new or existing sub-type, or the differentiation of diseases and patients thereof. In a further embodiment of the invention, the term "stratification" in particular includes the risk stratification with the prognosis of an "outcome" of a negative health event.

"Prognosis" means the prediction of the course of a disease.

In accordance with the invention, "therapy control" means, for example, the prediction and monitoring of the response to a drug or a therapy as well as aftercare.

Within the scope of this invention, the term "patient" is understood to mean any test subject, any individual (human or mammal), with the provision that the test subject or individual is tested for SLE.

The term "marker for SLE" in the sense of this invention means that the nucleic acid, for example DNA, in particular cDNA or RNA or the coded amino acid sequence or the polypeptide or protein are significant (specific) for SLE and/or the autoantibody profiles associated with SLE. Markers according to the invention are nucleic acid sequences and/or amino acid sequences according to the definition in the appended sequence protocol (SEQ ID No. 1 to SEQ ID No. 1584), homologues and subsequences thereof, wherein modified nucleic acid and amino acid sequences are also included. Here, marker for SLE means, for example, that the cDNA or RNA or the polypeptide or protein obtainable therefrom interacts with substances from the bodily fluid or tissue sample from a patient with SLE (for example antigen (epitope)/antibody (paratope) interaction). In a particularly preferred embodiment of the invention the marker for SLE is an antigen or part of an antigen or codes for an antigen or for part of an antigen.

The substances from the bodily fluid or tissue sample occur either only in an amplified manner or at least in an amplified manner in the case of SLE or are expressed, whereas these substances are not present in patients without SLE or healthy individuals, or at least are present to a lesser extent (smaller amount, lower concentration). Markers for SLE can also be characterised in that they interact with substances from the bodily fluid or tissue sample from patients with SLE, because these substances no longer occur or are no longer expressed or occur or are expressed at least in a much lower amount/concentration in the case of SLE, whereas these substances are present or are at least present to a much higher extent in patients without SLE. Markers for SLE can also be present in healthy test subjects, however the amount (concentration) thereof changes for example with the development, establishment and therapy of SLE. One or more markers can in this way map a profile of substances from bodily fluid and tissue sample, for example an SLE-associated autoantibody profile of the patient in question. Markers according to the invention are biomarkers for SLE.

Autoantibody profiles comprise the amount of one or more autoantibodies of which the occurrence/expression accompanies the development and/or establishment of SLE. Autoantibody profiles therefore include on the one hand the composition, i.e. one or more autoantibodies is/are expressed only in the case of SLE for example, and also the amount/concentration of individual autoantibodies, i.e. the amount/concentration of individual autoantibodies changes with the development and establishment of SLE. These changes can be detected with the aid of the marker sequences according to the invention.

In a particularly preferred embodiment the SLE marker identifies/binds to autoantibodies which are present (intensified) or are present to a lower extent (or no longer) during the course of the development, establishment and therapy of SLE. Autoantibodies are formed by the body against endogenous antigens which are formed for example in the case of SLE. Autoantibodies are formed by the body against different substances and pathogens. Within the scope of the present invention, the autoantibodies which are formed with the occurrence and during the course of the development of SLE and/or of which the expression is up-regulated or down-regulated are detected in particular. These autoantibodies can be detected with the aid of the methods and markers according to the invention, and the detection and monitoring (for example of the amount) thereof can be used for the early identification, diagnosis and/or therapy monitoring/therapy control and the prognosis and prediction of the risk of the re-occurrence of SLE within the scope of the after-care.

The autoantibody profiles can be sufficiently characterised with use of just a single SLE marker. In other cases, two or more SLE markers are necessary in order to map an autoantibody profile which is specific for SLE.

In one embodiment of the invention autoantibodies which derive from another individual and which for example originate from a commercial cDNA bank can be detected using SLE markers.

In another embodiment of the invention these autoantibodies can be detected using SLE markers which derive from the same individual and which for example originate from a cDNA bank produced individually for the patient or a group of patients for example within the scope of individualised medicine. By way of example, homologues of the specified SLE markers with the sequences SEQ ID. No. 1 to 1584 or subsequences thereof can be used.

Autoantibodies can be formed by the patient already many years prior to the occurrence of the first symptoms of disease. An early identification, diagnosis and also prognosis and preventative treatment or lifestyle change and other possibilities for prevention might therefore be possible even years prior to the visible outbreak of the disease. The devices, means and methods according to the invention enable a very early intervention compared with known methods, which significantly improves the prevention, treatment possibilities and effects of SLE.

Since the SLE-associated autoantibody profiles change during the establishment and treatment/therapy of SLE, the invention also enables the detection and monitoring of SLE at any stage of the development and treatment and also monitoring within the scope of SLE after-care. The means according to the invention, for example a corresponding diagnostic device or a test kit, also allow simple handling at home by the patient and an economical routine precautionary measure for early identification.

In particular due to the use of antigens as specific markers for SLE which derive from sequences already known, for example from commercial cDNA banks, test subjects can be tested and any present SLE-associated autoantibodies can be detected in these test subjects, even if the corresponding autoantigens are not (yet) known in these test subjects.

Different patients can have different SLE-associated autoantibody profiles, for example different cohorts or population groups can differ from one another. Here, any patient can form one or more different SLE-associated autoantibodies during the course of the development of SLE and the progression of the SLE disease, that is to say even different autoantibody profiles. In addition, the composition and/or the amount of formed autoantibodies can change during the course of the SLE development and progression of the disease, such that a quantitative evaluation is necessary. The therapy/treatment of SLE leads to changes in the composition and/or the amount of SLE-associated autoantibodies. The large selection of SLE markers according to the invention which are provided with this invention enables the individual compilation of SLE markers in an arrangement, i.e. a panel, for individual patients, groups of patients, certain cohorts, population groups and the like. In one individual case, the use of one SLE marker may therefore be sufficient, whereas in other cases at least two or more SLE markers must be used together or in combination in order to create a conclusive autoantibody profile.

Compared with other biomarkers, the detection of SLE-associated autoantibodies for example in the serum or plasma of patients has the advantage of high stability and storage capability and good detectability. The presence of autoantibodies also is not subject to a circadian rhythm, and therefore the sampling is independent of the time of day, food intake, and the like.

In addition, the SLE-associated autoantibodies can be detected with the aid of the corresponding antigens/autoantigens in known assays, such as ELISA or Western Blot, and the results can be checked in this way.

In the sense of the invention, an interaction between the SLE marker and the serum in question, for example an autoantibody of the patient, is detected. Such an interaction is, for example, a bond, in particular a binding substance on at least one SLE-specific marker, or, in the case that the SLE-specific marker is a nucleic acid, for example a cDNA, the hybridisation with a suitable substance under selected conditions, in particular stringent conditions (for example as defined conventionally in J. Sambrook, E. F. Fritsch, T. Maniatis (1989), Molecular cloning: A laboratory manual, 2nd Edition, Cold Spring Harbor Laboratory Press, Cold Spring Harbor, USA or Ausubel, "Current Protocols in Molecular Biology", Green Publishing Associates and Wiley Interscience, N.Y. (1989)). One example of stringent hybridisation conditions is: hybridisation in 4×SSC at 65° C. (alternatively in 50% formamide and 4×SSC at 42° C.), followed by a number of washing steps in 0.1×SSC at 65° C. for a total of approximately one hour. An example of less stringent hybridisation conditions is hybridisation in 4×SSC at 37° C., followed by a number of washing steps in 1×SSC at room temperature. The interaction between the bodily fluid or tissue sample from a patient and the markers for SLE is preferably a protein-protein interaction.

In accordance with the invention, such substances, for example antigens, autoantigens and SLE-associated autoantibodies, are part of a bodily fluid, in particular blood, whole blood, blood plasma, blood serum, patient serum, urine, cerebrospinal fluid, synovial fluid or a tissue sample from the patient. The invention in particular relates to the use of these bodily fluids and tissue samples for early detection, diagnosis, prognosis, therapy control and aftercare.

The SLE-specific markers, in a further embodiment of the invention, have a recognition signal that is addressed to the substance to be bound (for example antibody, nucleic acid). In accordance with the invention, the recognition signal for a protein is preferably an epitope and/or paratope and/or hapten, and for a cDNA is preferably a hybridisation or binding region.

Homologues of the markers according to the invention SEQ ID No. 1 to 1584, as presented in the claims for example are also included. Within the sense of the invention, homologues are those with homology of the amino or nucleic acid sequence and those in which the corresponding sequence is modified, for example the protein variants, which indeed have the same amino acid sequence, but differ with regard to the modification, in particular the post-translational modification.

In accordance with the invention, modifications of the nucleic acid sequence and of the amino acid sequence, for example citrullination, acetylation, phosphorylation, glycosylation, ethylation, or polyA strand extensions and further modifications known as appropriate to a person skilled in the art are included.

Homologues also include sequence homologues of the markers and subsequences thereof. Sequence homologues are, for example, nucleic acid sequences and/or protein sequences that have an identity with the SLE markers of the sequences SEQ ID No. 1 to 1584 of at least 70% or 80%, preferably 90% or 95%, particularly preferably 96% or 97% or more, for example 98% or 99%. In a particularly preferred embodiment of the invention, for the case in which the SLE markers are antigens, the homology in the sequence range in which the antigen-antibody or antigen-autoantibody interaction takes place, is at least 95%, preferably at least 97%, particularly preferably at least 99%. For example, mutations such as base exchange mutations, frameshift mutations, base insertion mutations, base loss mutations, point mutations and insertion mutations, are included in accordance with the invention.

The invention also relates to subsequences of the SLE markers with the sequence SEQ ID No. 1 to 1584. Subsequences also include nucleic acid or amino acid sequences that are shortened compared with the entire nucleic acid or the entire protein/peptide. Here, the deletion may occur at the end or the ends and/or within the sequence. For example, subsequences and/or fragments that have 50 to 100 nucleotides or 70-120 nucleotides of the sequence SEQ ID No. 1 to 1584 are included. Homologues of subsequences are also included in accordance with the invention. In a particular embodiment, the SLE markers are shortened compared with the sequences SEQ ID No. 1 to 1584 to such an extent that they still consist only of the binding point(s) for the SLE-associated autoantibody in question. In accordance with the invention, SLE markers are also included that differ from the sequences SEQ ID No. 1 to 1584 in that they contain one or more insertions, wherein the insertions for example are 1 to 100 or more nucleotide/amino acids long, preferably 5 to 50, particularly preferably 10 to 20 nucleotides/amino acids long and the sequences are otherwise identical however or homologous to sequences SEQ ID No. 1 to 1584. Subsequences that have at least 90%, preferably at least 95%, particularly preferably 97% or 98%, of the length of the SLE markers according to the invention with sequences SEQ ID No. 1 to 1584 are particularly preferred.

In a further embodiment, the respective SLE marker can be represented in different quantities in one or more regions in the arrangement or on the substrate or in a panel. This allows a variation of the sensitivity. The regions may each have a totality of SLE markers, that is to say a sufficient number of different SLE markers, in particular 2, 3, 4, 5, 6, 7, 8, 9 or 10 or more different SLE markers. By way of example, 20 to 50 (numerically) or more, preferably more than 100, particularly preferably 150 or more, for example 25,000 or 5000 or 10000 different or same SLE marker sequences and where applicable further nucleic acids and/or proteins, in particular other biomarkers can be represented on the substrate or in the panel.

One or more panels as presented in the examples and selected from the sequences, preferably protein sequences, consisting of at least two markers, five markers or 10 markers or more, selected from:

panel I (P1)

SEQ ID No. 1, 2, 3, 5, 7, 8, 10, 12, 13, 15, 17, 18, 19, 20, 24,

SEQ ID No. 528, 529, 530, 532, 534, 535, 537, 539, 540, 542, 544, 545, 546, 547, 551, preferably SEQ ID No. 1057, 1058, 1059, 1061, 1063, 1064, 1066, 1068, 1069, 1071, 1073, 1074, 1075, 1076, 1080, and/or panel II (P2)

SEQ ID No. 1, 3, 4, 5, 7, 12, 13, 14, 15, 17, 18, 19, 20, 24

SEQ ID No. 528, 530, 531, 532, 534, 539, 540, 541, 542, 544, 545, 546, 547, 551, preferably SEQ ID No. 1057, 1059, 1060, 1061, 1063, 1068, 1069, 1070, 1071, 1073, 1074, 1075, 1076, 1080, and/or panel III (P3)

SEQ ID No. 1, 2, 3, 5, 6, 7, 8, 9, 10, 15, 16, 18, 21, 23

SEQ ID No. 528, 529, 530, 532, 533, 534, 535, 536, 537, 542, 543, 545, 548, 550, preferably SEQ ID No. 1057, 1058, 1059, 1061, 1062, 1063, 1064, 1065, 1066, 1071, 1072, 1074, 1077, 1079, and/or panel IV (P4)

SEQ ID No. 1, 2, 3, 4, 5, 8, 9, 10, 12, 13, 14, 15, 17, 19, 20

SEQ ID No. 528, 529, 530, 531, 532, 533, 536, 537, 539, 540, 541, 542, 544, 546, 547, preferably SEQ ID No. 1057, 1058, 1059, 1060, 1061, 1064, 1065, 1066, 1068, 1069, 1070, 1071, 1073, 1075, 1076, and/or panel V SEQ ID No. 1, 2, 3, 4, 5, 6, 7, 11, 15, 16, 18, 21, 22, 23, 24

SEQ ID No. 528, 529, 530, 531, 532, 533, 534, 538, 542, 543, 545, 548, 549, 550, 551, preferably SEQ ID No. 1057, 1058, 1059, 1060, 1061, 1062, 1063, 1067, 1071, 1072, 1074, 1077, 1078, 1079, 1080, and/or panel VI SEQ ID No. 2, 5, 6, 7, 8, 10, 13, 18, 19, 22, 168

SEQ ID No. 529, 532, 533, 534, 535, 537, 540, 545, 546, 549, 695, preferably

SEQ ID No. 1058, 1061, 1062, 1063, 1064, 1066, 1069, 1074, 1075, 1078, 1224, and/or panel VII SEQ ID No. 1, 2, 5, 6, 7, 8, 9, 10, 13, 15, 19, 22, 24, 134, 168, 213, 367, 368, 369

SEQ ID No. 528, 529, 532, 533, 534, 535, 536, 537, 540, 542, 546, 549, 551, 661, 695, 741, 895, 896, 897, preferably SEQ ID No. 1057, 1058, 1061, 10642, 1063, 1064, 1065, 1066, 1069, 1071, 1075, 1078, 1080, 1190, 1224, 1270, 1424, 1425, 1426, and/or panel VIII (P8)

SEQ ID No. 1, 2, 4, 5, 6, 7, 8, 9, 10, 12, 13, 15, 17, 18, 19, 20, 21, 22, 23, 24, 29, 31, 46, 95, 128, 134, 136, 143, 163, 168, 169, 171, 188, 213, 348, 367, 368, 369, 370-391, 423-433

SEQ ID No. 528, 529, 531, 532, 533, 534, 535, 536, 537, 539, 540, 542, 544, 545, 546, 547, 548, 549, 550, 551, 556, 558, 573, 622, 655, 661, 663, 690, 695, 696, 698, 715, 741, 876, 895, 896, 897, 898-919, 951-961, preferably SEQ ID No. 1057, 1058, 1060, 1061, 1062, 1063, 1064, 1065, 1066, 1068, 1069, 1071, 1073, 1074, 1075, 1076, 1077, 1078, 1079, 1080, 1085, 1087, 1102, 1151, 1184, 1190, 1192, 1219, 1220, 1224, 1225, 1227, 1244, 1270, 1405, 1424, 1425, 1426, 1427-1448, 1480-1490, and/or panel IX (P9)

SEQ ID No. 1, 2, 3, 4, 5, 6, 7, 8, 9, 10, 11, 12, 13, 14, 15, 16, 17, 18, 19, 20, 21, 22, 23, 24, 29, 31, 33, 41, 46, 48, 74, 95, 105, 108, 114, 115, 116, 128, 132, 134, 136, 143, 163, 168, 169, 171, 188, 213, 348, 367, 368, 369, 370-391, 423-433

SEQ ID No. 528, 529, 530, 531, 532, 533, 534, 535, 536, 537, 538, 539, 540, 541, 542, 543, 544, 545, 546, 547, 548, 549, 550, 551, 556, 558, 560, 568, 573, 575, 601, 622, 632, 635, 641, 642, 643, 655, 659, 661, 663, 670, 690, 695, 696, 698, 715, 741, 876, 895, 896, 897, 898-919, 951-961, preferably SEQ ID No. 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1085, 1087, 1089, 1097, 1102, 1104, 1130, 1151, 1161, 1164, 1170, 1171, 1172, 1184, 1188, 1190, 1192, 1199, 1219, 1224, 1225, 1227, 1244, 1270, 1405, 1424, 1425, 1426, 1427-1448, 1480-1490 or respective homologues or subsequences thereof, as mentioned previously with regard to the individual marker sequences, is/are very particularly preferred.

These aforementioned panels particularly advantageously allow the execution of the method according to the invention; see the examples.

Within the scope of this invention, "arrangement" is synonymous with "array", and, if this "array" is used to identify substances on SLE markers, this is to be understood preferably to be an "assay" or a bead or a diagnostic device or a screening assay. In a preferred embodiment, the arrangement is designed such that the markers represented on the arrangement are present in the form of a grid on a substrate. Furthermore, those arrangements are preferred that permit a high-density arrangement of SLE markers. The markers are preferably spotted. Such high-density spotted arrangements are disclosed for example in WO 99/57311 and WO 99/57312 and can be used advantageously in a robot-supported automated high-throughput method.

Within the scope of this invention, however, the term "assay" or diagnostic device likewise comprises those embodiments such as ELISA, bead-based assay, line assay, Western Blot, and immunochromatographic methods (for example what are known as lateral flow immunoassays) or similar immunological single or multiplex detection methods.

A "protein array" in the sense of this invention is the systematic arrangement of SLE markers on a solid substrate, wherein the substrate can have any shape and/or size, and wherein the substrate is preferably a solid substrate.

The SLE markers of the arrangement/panel are fixed on the substrate, preferably spotted or immobilised, printed on or the like, in particular in a reproducible manner. One or more SLE markers can be present multiple times in the totality of all SLE markers and may be present in different quantities based on a spot. Furthermore, the SLE markers can be standardised on the substrate (for example by means of serial dilution series of, for example, human globulins as internal calibrators for data normalisation and quantitative evaluation). A standard (for example a gold standard) can also be applied to the substrate where necessary.

In a further embodiment, the SLE markers are present as clones. Such clones can be obtained for example by means of a cDNA expression library according to the invention. In a preferred embodiment, such expression libraries are obtained using expression vectors from a cDNA expression library comprising the cDNAs of the SLE-specific marker sequences. These expression vectors preferably contain inducible promoters. The induction of the expression can be carried out for example by means of an inducer, such as IPTG. Suitable expression vectors are described in Terpe et al. (Terpe T Appl Microbiol Biotechnol. 2003 January; 60(5):523-33).

Expression libraries are known to a person skilled in the art; they can be produced in accordance with standard works, such as Sambrook et al, "Molecular Cloning, A laboratory handbook, 2nd edition (1989), CSH press, Cold Spring Harbor, N.Y. Expression libraries that are tissue-specific (for example human tissue, in particular human organs) are furthermore preferable. Further, expression libraries that can be obtained by means of exon trapping are also included in accordance with the invention.

Protein arrays or corresponding expression libraries that do not exhibit any redundancy (what is known as a Uni-clone® library) and that can be produced for example in accordance with the teaching of WO 99/57311 and WO 99/57312 are furthermore preferred. These preferred Uni-clone® libraries have a high proportion of non-defective fully expressed proteins of a cDNA expression library.

Within the scope of this invention, the clones can also be, but are not limited to, transformed bacteria, recombinant phages or transformed cells of mammals, insects, fungi, yeasts or plants.

The clones are fixed, spotted or immobilised on a solid substrate. The invention therefore relates to an arrangement/use, wherein the SLE-specific markers are present as clones.

In addition, the SLE markers can be present in the respective form in the form of a fusion protein, which for example contains at least one affinity epitope or "tag", wherein the tag is selected for example from c-myc, his tag, arg tag, FLAG, alkaline phosphatase, V5 tag, T7 tag or strep tag, HAT tag, NusA, S tag, SBP tag, thioredoxin, DsbA, or the fusion protein has one or more additional domains for example, such as a cellulose-binding domain, green fluorescent protein, maltose-binding protein, calmodulin-binding protein, glutathione S-transferase or lacZ.

In a further embodiment the invention relates to an assay, for example a multiplex assay, a bead-based assay, or protein array for identifying and characterising a substance, for example a hit, a lead substance, or an active substance for SLE. Here, a substance to be tested is used. This can be any native or non-native biomolecule, a (synthetic) chemical molecule, a natural substance, a mixture or a substance library. Once the substance to be tested has contacted an SLE marker, the binding success is evaluated, for example with use of commercially available image-analysis software (GenePix Pro (Axon Laboratories), Aida (Raytest), ScanArray (Packard Bioscience).

Binding according to the invention, binding success, interactions, for example protein-protein interactions (for example protein to SLE marker, such as antigen/antibody) or corresponding "means for detecting the binding success" can be visualised for example by means of fluorescence labelling, biotinylation, radio-isotope labelling or colloid gold or latex particle labelling in the conventional manner. Bound antibodies are detected with the aid of secondary antibodies, which are labelled using commercially available reporter molecules (for example Cy, Alexa, Dyomics, FITC or similar fluorescent dyes, colloidal gold or latex particles), or with reporter enzymes, such as alkaline phosphatase, horseradish peroxidase, etc. and the corresponding colorimetric, fluorescent or chemoluminescent substrates. A read-out is performed for example by means of a microarray laser scanner, a CCD camera or visually.

In a further embodiment, the invention relates to a drug or an active substance or prodrug for SLE, developed and obtainable by the use of an SLE marker according to the invention.

The invention also relates to the use of an SLE marker selected from sequences SEQ ID No. 1 to 1584 and subsequences of SEQ ID No. 1 to 1584 with at least 90%, preferably at least 95% of the length of SEQ ID No. 1 to 1584 and homologues of SEQ ID No. 1 to 1584 and subsequences thereof with an identity of at least 95%, preferably at least 98% or more, to the corresponding sequences and proteins/peptides coded by the sequences SEQ ID No. 1 to 1056, coded by the subsequences thereof and homologues as affinity material for carrying out an apheresis or blood washing for patients with SLE, i.e. apheresis of SLE autoantibodies. The invention thus relates to the use of the markers according to the invention, preferably in the form of an arrangement, as affinity material for carrying out an apheresis or a blood washing in the broader sense, wherein substances from bodily fluids from a patient with SLE, such as blood or plasma, bind to the markers according to the invention and consequently can be removed selectively from the bodily fluid. The application in blood washing is a special case of use of the SLE markers as a target. Devices for carrying out a blood washing, in particular immunapheresis, are known to a person skilled in the art and can be carried out for example by means of dialysis.

The following examples and drawings explain the invention, but do not limit the invention to the examples.

Figure 3:
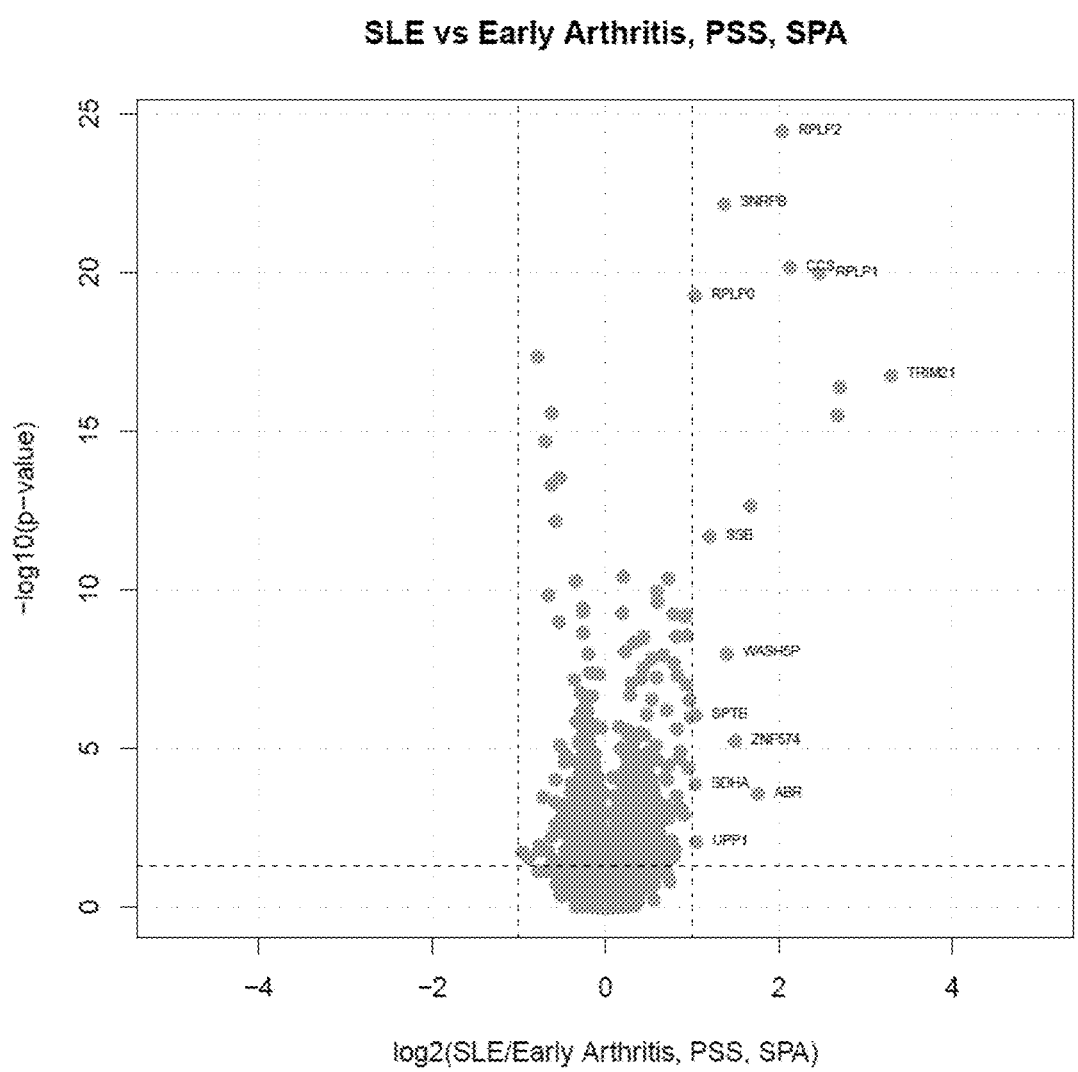

FIG. 3: volcano plot of the antigen reactivities of SLE patients compared with a combined group of patients with various autoimmune diseases, such as SSc (PSS), SPA, early rheumatoid arthritis and SPA.

Figure 4:
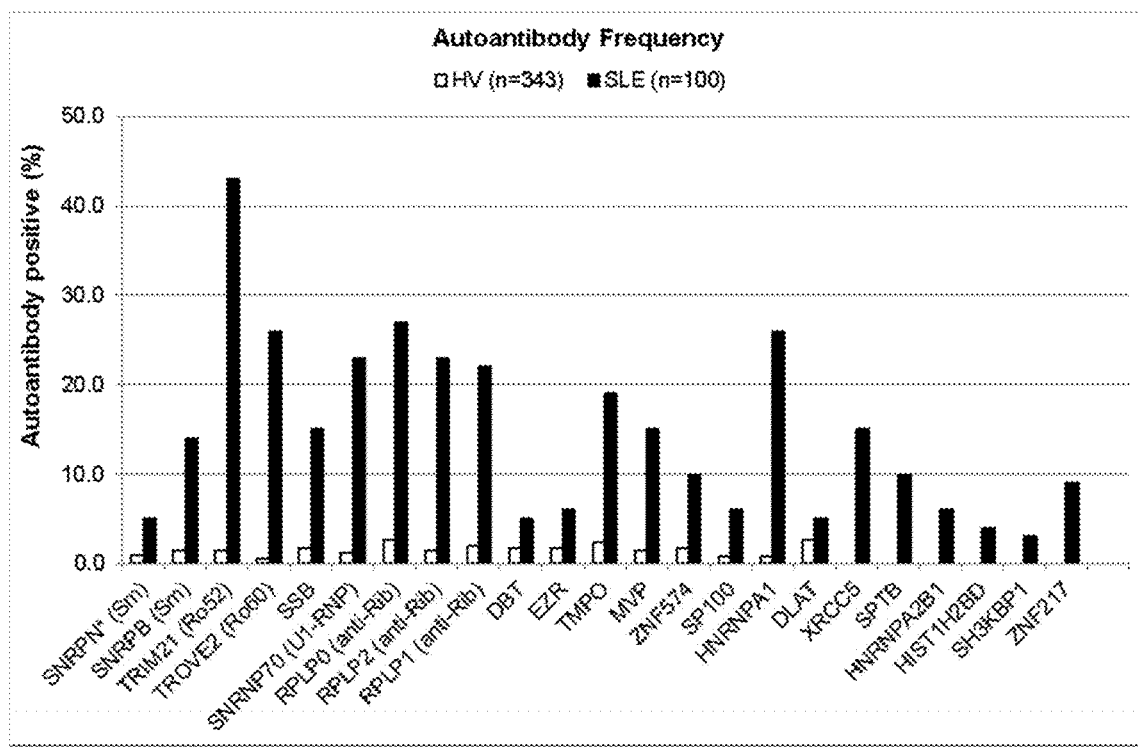

FIG. 4 frequency of the autoantibody reactivities of selected antigens in SLE patients and healthy test subjects. A threshold value of 3 SD deviations above the mean value of the healthy test subject was applied. The threshold value for the antigen SNRNP was set to 2SD.

Figure 5:
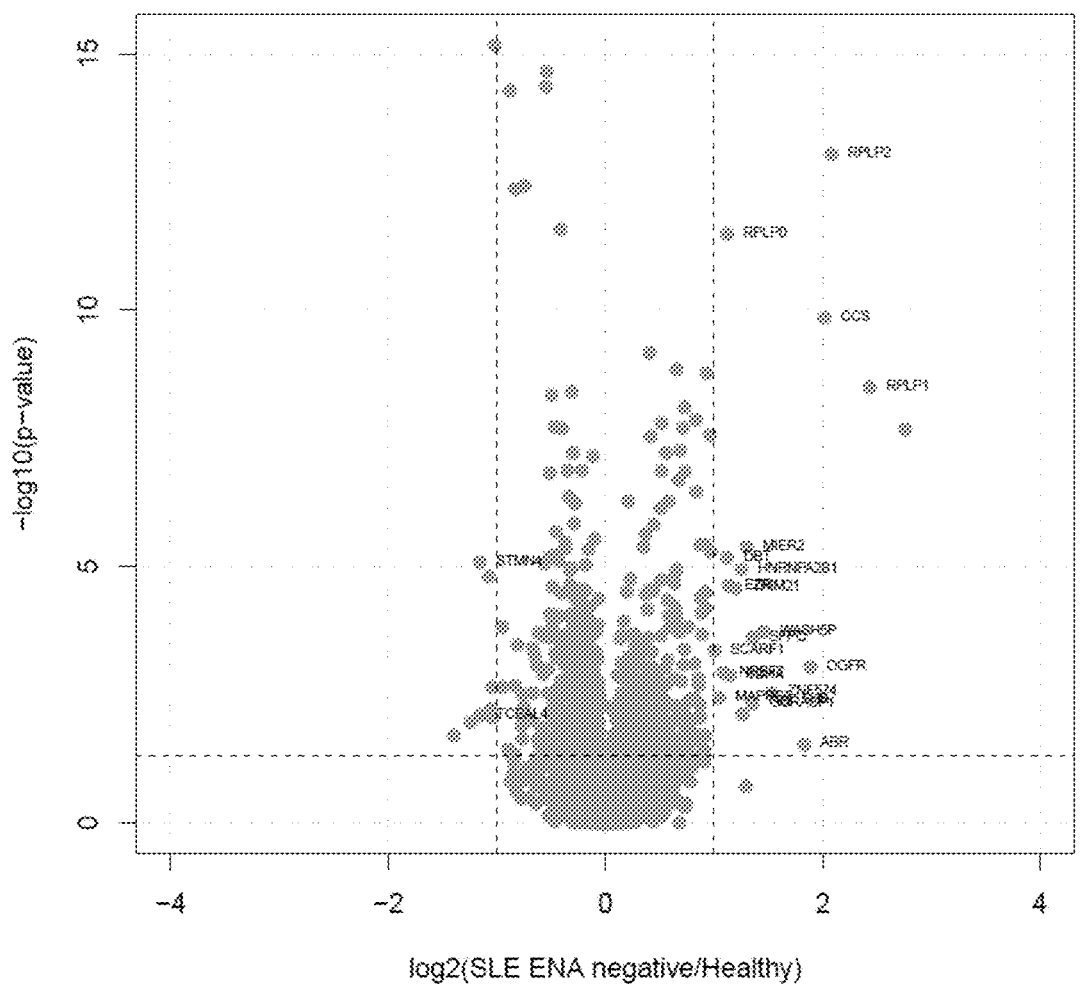

FIG. 5: volcano plot of the autoantibody reactivities of ENA-4-negative SLE patients compared with healthy controls.

Figure 6:
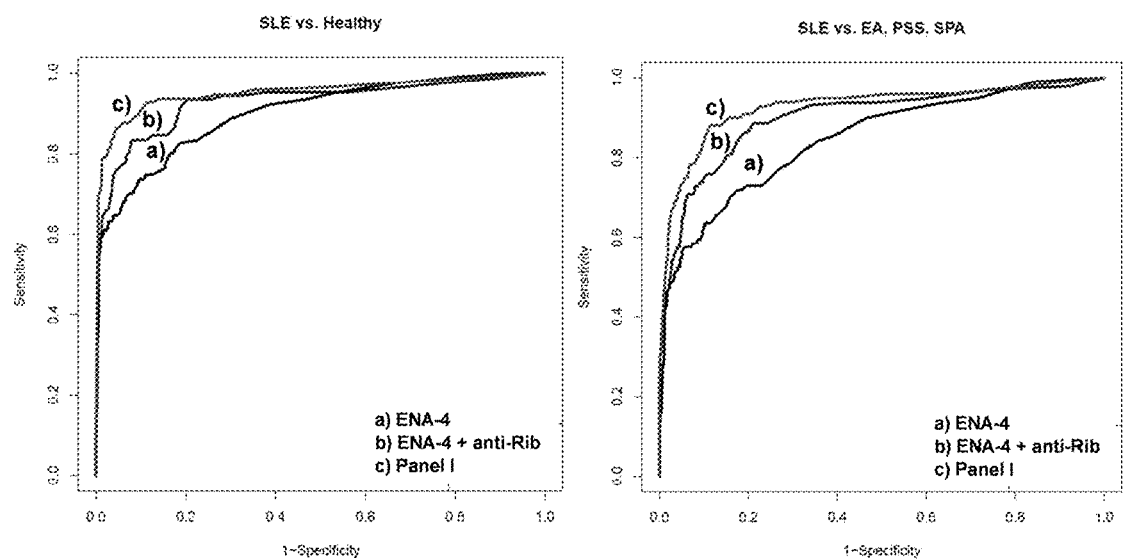
Figure 7:
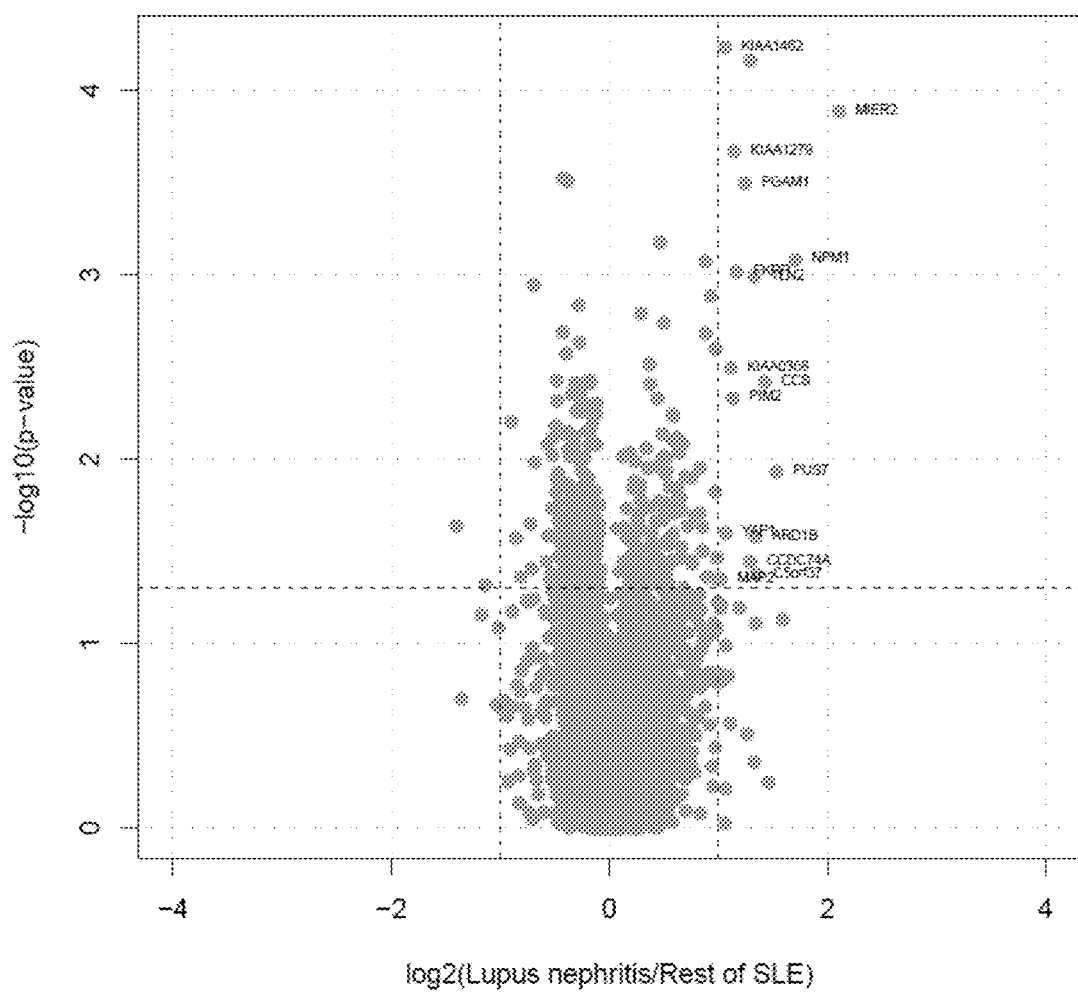
Figure 8:
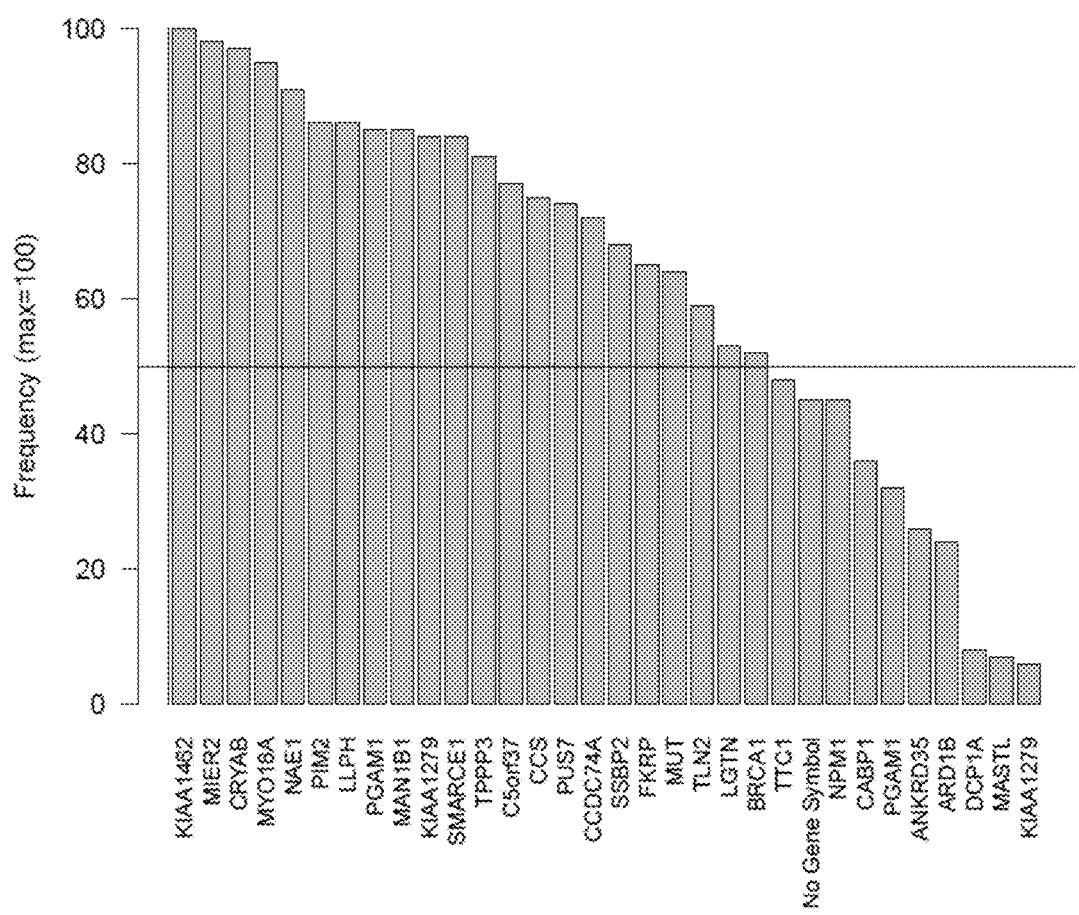

FIG. 6: receiver operating characteristic curves (ROCs) for the diagnosis of SLE compared to healthy test subjects and AID samples FIG. 7: volcano plot for SLE lupus nephritis compared with SLE without lupus nephritis FIG. 8: frequency of the lupus nephritis antigens in a model with nested cross validation.

Figure 9:
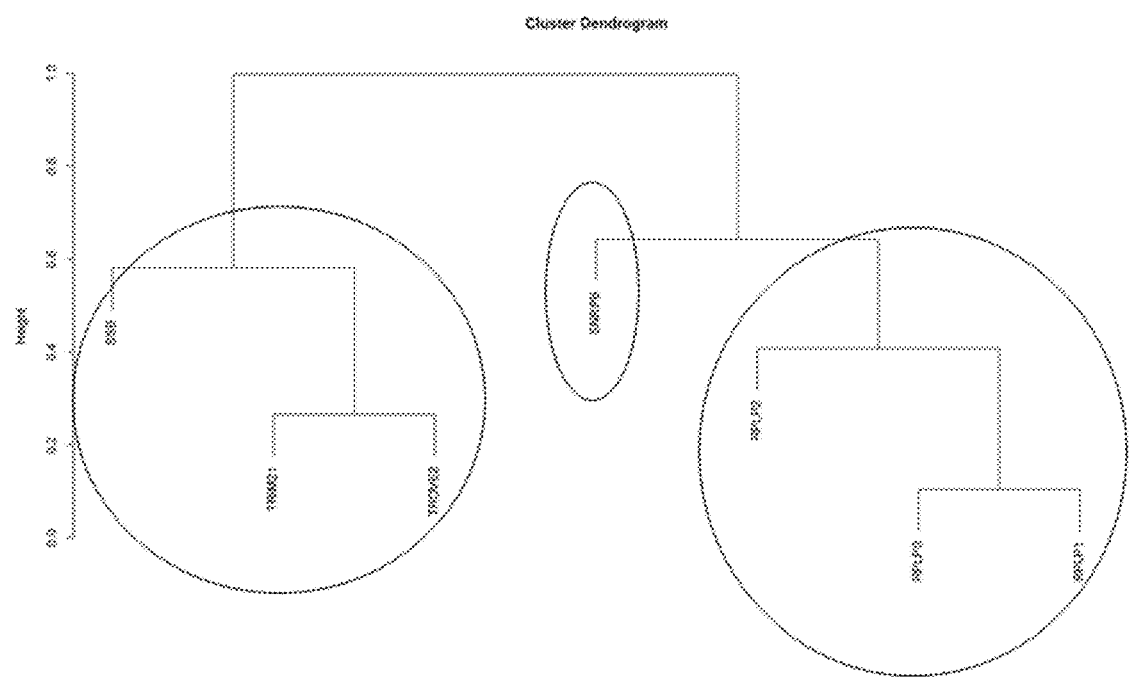
Figure 9:
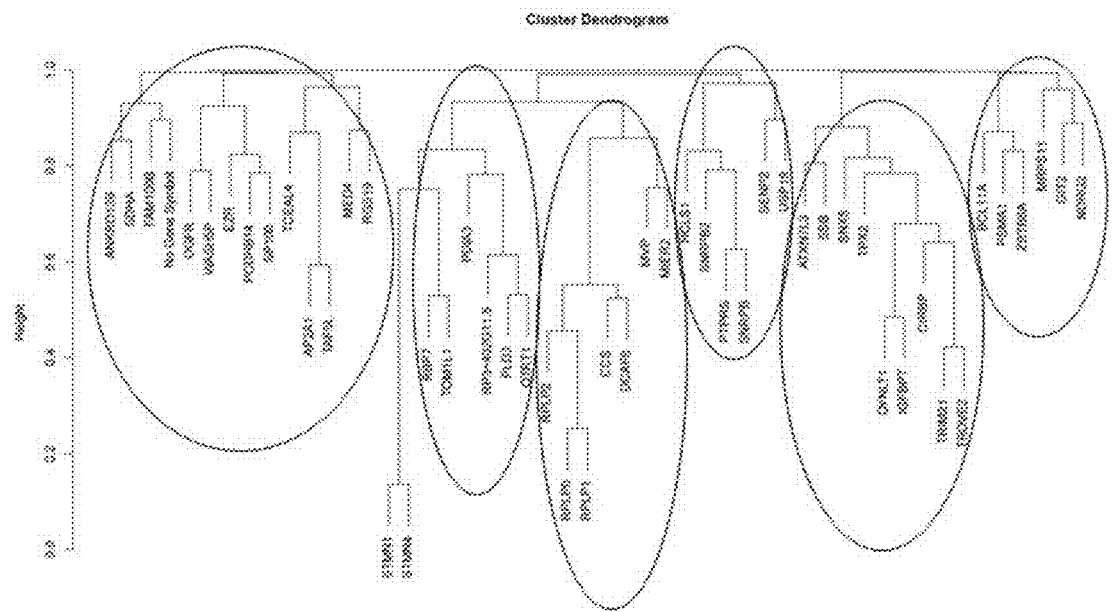

FIG. 9: dendogram of the SLE antigens following calculation of Spearman's rank correlation coefficient a) dendogram of the known ENA-4 antigens and b) dendogram of 50 selected SLE antigens.

FIG. 10: PPLS-DA biplot of the SLE patients and healthy controls with use of the SLE antigens a) PPLS-DA biplot based on the ENA-4 and ribosomal antigen b) PPLS-DA biplot based on 50 SLE antigens.

EXAMPLES

Example 1

Selection of the SLE Patients and Test Subjects

Selection of the patient groups to be tested: Blood samples were analysed from 129 SLE patients, 100 patients with systemic sclerosis (SSc, PSS), 75 patients with rheumatoid arthritis (RA), 537 patients with early RA (period of disease less than 6 months) and 75 patients with ankylosing spondylitis (SPA)/Bekhterev's disease (SPA). 343 blood samples from the Bavarian Red Cross (BRC) were used as control group. An informed consent of the Ethics Commission of the clinical partners and of the biobank of the BRC was received from all test subjects.

TABLE 1

Patient samples and clinical data (test cohort I)

| | 1. Screen | | | 2. Screen | | | | | |
|---|---|---|---|---|---|---|---|---|---|
| | | | | SLE | SSc (PSS) | | Early RA | | |
| | SLE | RA | Healthy | SLE | Total | Sub-type | (<6 months) | SPA | Healthy |
| Number | 129 | 75 | 123 | 100 | 100 | | 537 | 82 | 343 |
| Age (years) | 39 +/− 12 | 56.6 +/− 13.2 | 41.3 +/− 11 | 39.8 +/− 11.9 | 56.9 +/− 13.4 | Limited n = 50 | 56.8 +/− 14.3 | 43.7 +/− 10.1 | 47.7 +/− 11.7 |
| % female | 86.1 | 72 | 86.2 | 83 | 87 | Diffuse n = 32 | 62.2 | 15.9 | 58.3 |
| % ANA | 77.5 | N.D. | N.D. | 100 | 95 | Overlap n = 9 | N.D. | N.D. | N.D. |
| SLAM | 7.7 +/− 5.1 | | | 7.7 +/− 5.1 | | | | | |
| SLICC | 1.45 +/− 1.8 | | | 1.45 +/− 1.8 | | | | | |
| ANA % | | | | | | | | | |
| ENA-4 positive % | 37 | | | 48 | | | | | |
| U1-RNP (% of ENA-4 pos.) | 13 | | | 13 | | | | | |
| Sm (% of ENA-4 pos.) | 8 | | | 8 | | | | | |
| SS-A/Ro52 (% of ENA-4 pos.) | 35 | | | 35 | | | | | |
| SS-B/Ro60 (% of ENA-4 pos.) | 10 | | | 10 | | | | | |
| Kidney involvement % | 26.4 | | | 34 | | | | | |

Example 2

Antigen Production

Five cDNA libraries that had been produced from different human tissues (foetal brain, intestine, lung, liver and T-cells) were used for the production of the recombinant antigens. All cDNAs were expressed in *E. coli* under the transcriptional control of the lactose-inducible promoter. The resultant proteins carry, at their amino terminus, an additional sequence for a hexahistidine purification tag (His6 tag). Target antigens which were not present in the cDNA library were produced by chemical synthesis (Life Technologies) and cloned into the expression vector pQE30-NST, which already codes an amino-terminal His6 tag.

Following recombinant expression of the proteins, these were isolated in denaturising conditions and purified by means of metal affinity chromatography (IMAC). The proteins were lyophilised and stored at −20° C. until further use (lifesciences.sourcebioscience.com).

Example 3

Production of the BBAs

The production of BBAs was adapted to a microtitre plate format, such that 384 coupling reactions could be assessed in parallel using automated pipette systems (Starlet, Hamilton Robotics, Evo Freedom 150, Tecan). For the use of automated pipette systems, the individual bead regions were transferred into coupling plates (96 well Greiner) and the antigens were transferred into 2D barcode vessels (Thermo Scientific). For each coupling reaction, 0.6 to 2.5 million beads and, depending on the antigen, 1 to 100 µg protein were used.

All washing and pipetting steps of the coupling reaction were carried out in coupling plates which were fixed on magnets.

The beads were washed twice with 100 µl LxAP buffer (100 mM NaH2PO4, pH 6.2) and then received in 120 µl LxAP buffer. For the activation, 15 µl 1-ethyl-3-(3-dimethylaminopropyl)carbodiimide (EDC; 50 mg/ml) and 15 µl N-hydroxysulfosuccinimide (sulfo-NHS; 50 mg/ml) were added by pipette to form a bead suspension, and these suspensions were then incubated for 20 minutes in the shaker (RT, 900 rpm, protected against light). The beads were then washed 3× with 150 µl LxKPT buffer and then the protein solution was added. Following an incubation period of two hours in the shaker (RT, 900 rpm, protected against light), the beads were then washed three times with 150 µl LxKPT buffer. To block free binding points, 100 µl LxCBSP buffer (PBS, 1% BSA, 0.05% ProClin300) were added, and these mixtures were then incubated for 20 min in the shaker (RT, 900 rpm, protected against light). This was followed by incubation over night at 4-8° C. The BBA was produced by the combination of beads coupled to antigens and was stored at 4-8° C., protected against light, until use.

Example 4

Quality Control of the BBAs

In order to check the immobilisation of the proteins at the respective bead regions, a coupling control was carried out.

Here, different amounts of beads were used (250, 500 and 750 beads per bead region). For a reaction mixture, 500 beads for example per bead region were diluted in LxCBS buffer (PBS, 1% BSA) and transferred into an assay plate (96 well half area microplate, Greiner).

Before each washing step, the assay plate with the beads was placed for 2 minutes on a magnet and the supernatant was then removed. After three washing steps, the beads were incorporated with 100 µl LxWPT buffer (PBS, 0.05% Tween-20), and 10 µg/ml penta-his antibodies (Qiagen) or LxCBS buffer (PBS, 1% BSA) were added by pipette. Following incubation for 45 minutes in the shaker (RT, 900 rpm, protected against light), the supernatant was removed and the beads were washed in two steps. 5 µg/ml goat anti-mouse IgG-PE (Phycoerythrin) or goat anti-human IgG-PE (Dianova) were then added as secondary antibody to the reaction mixture and incubated for 30 minutes. Following two washing steps, 100 µl of carrier liquid (Luminex) was added to the beads. The fluorescence signal of the beads was detected with the aid of the FlexMAP3D instrument. Here, the bead count on the one hand and the median of the fluorescence intensity (MFI value) on the other hand were measured.

Example 5

Application of BBAs

For application, BBAs were incubated with sera and all IgG-based autoantibodies bonded to antigens were detected with the aid of a secondary antibody. In order to enable a high throughput of measurements, the application of BBAs was adapted to a microtiter plate format so that either an 8-channel (Starlet, Hamilton Robotics) or a 96-channel (Evo Freedom 150, Tecan) automated pipetting system could be used. The sera to be examined were transferred into 2D barcode vessels and then diluted 1:100 with assay buffer (PBS, 0.5% BSA, 10% E. coli lysate, 50% low-cross buffer (Candor Technologies)). In order to neutralise human antibodies directed against E. coli, a pre-incubation of the sera dilutions was performed for 20 min. In this time, 500 beads per bead region were distributed in the assay plate. 50 µl of diluted serum were added to the beads in the coupling plate, and the reaction mixtures were incubated for 18-22 h in the shaker (4-8° C., 900 rpm, protected against light). After three washing steps in each case with 100 µl LxWPT buffer, 5 µg/ml of the detection antibody goat anti-human IgG-PE (Dianova) were added to the reaction mixtures and incubated for 1 h in the shaker (RT, 900 rpm). The beads were then washed three times with 100 µl LxWPT and incorporated in 100 µl carrier liquid (Luminex). The fluorescence signal of the beads was detected with the aid of the FlexMAP3D instrument. Here, the bead count on the one hand and the MFI value (median fluorescence intensity) on the other hand were measured.

Example 6

Biostatistical Analysis

The biostatistical analysis comprised univariate and multivariate methods for describing the statistical properties of individual antigens and of groups of antigens. In order to discover interesting candidates for panels, the key property was a good separation between the groups of samples based on the MFI values. In order to find antigen candidates for panel generation, univariate testing, receiver operating characteristic (ROC) analyses, correlation profiles, powered partial least squares discriminant analysis (PPLS-DA) and random forests were used as methods. Biostatistical analyses were subject to expert assessment in order to define final antigen panels.

Before the statistical analysis, the MFI values were log 2-transformed in order to reduce the skew in the distributions. If more than 20% of the values were missing, antigens were excluded from the analysis. Missing values were replaced by median imputation. A quantile normalisation was carried out under consideration of the reference sera in order to normalise, per BBA set, all measured samples on individual plates.

Besides descriptive standardisation for MFI values, non-parametric tests were also carried out with the aid of the two-sided Mann-Whitney-U test in order to uncover differences in the median values of the groups. The test level for multiple testing was corrected in accordance with the Bonferroni-Holm procedure. In addition, the Benjamin-Hochberg procedure inclusive of the determination of the False Discovery Rate (FDR, q-value) was applied. In addition, fold-change and effect size were determined. In order to assess the classification quality, an ROC analysis was carried out, within the scope of which sensitivity, specificity and the area under the ROC curve (AUC) were calculated, in each case inclusive of the 95% confidence interval on the basis of the bootstrap method. Boxplots and volcano plots were used for graphical representation. A scoring system was implemented on the basis of the univariate results.

By means of the application of a PPLS-DA, it was attempted to maximise the correlation between the component of the response matrix. A linear discriminant analysis with the latent component as predictors was used for the final classification. A random forest was applied, in which binary decision trees are combined. The decision trees were formed on the basis of a number of bootstrap samples of a training sample and by random selection of a subgroup of explaining variables at each node. The number of input variables, which was selected randomly with each division step, was determined as the square root of the total number of variables, and the number of trees in the random forest was set to 1000. A cross validation with 500 times throughput was implemented for both multi-variant approaches.

Example 7

Autoantibodies/Antigen Reactivities Differentiate SLE from Healthy Controls, Rheumatoid Arthritis and Other Autoimmune Diseases In a first screening the antigen reactivities of 129 SLE patients, 75 RA patients, and 134 healthy controls categorised in accordance with age and sex were differentially tested. For this purpose, the autoantibody reactivities of these blood samples were tested on 5857 antigens coupled to Luminex beads.

Figure 1:
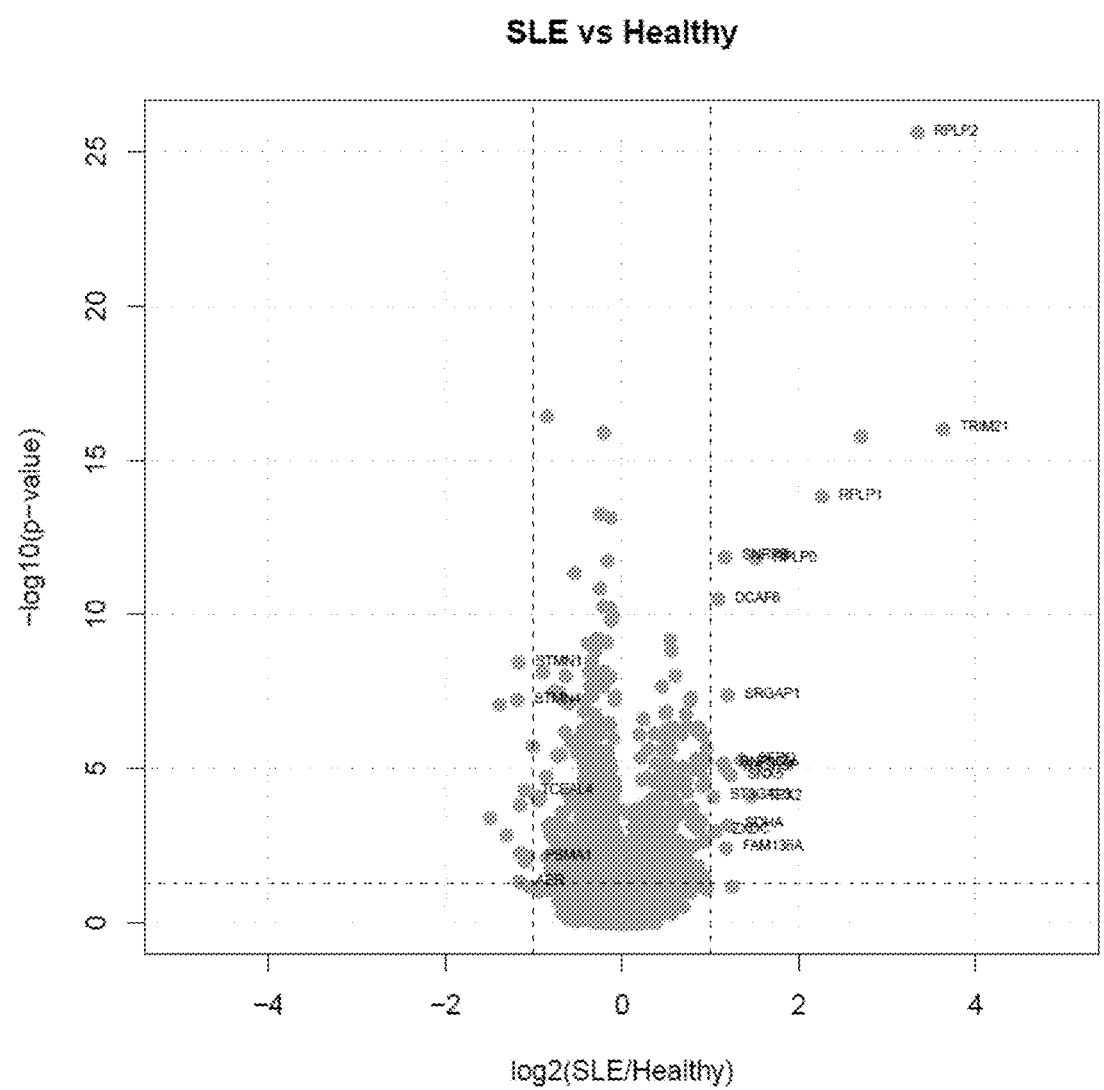
FIG. 1 shows a volcano plot of the relative antigen reactivities of the SLE patients compared to healthy controls.
Figure 2:
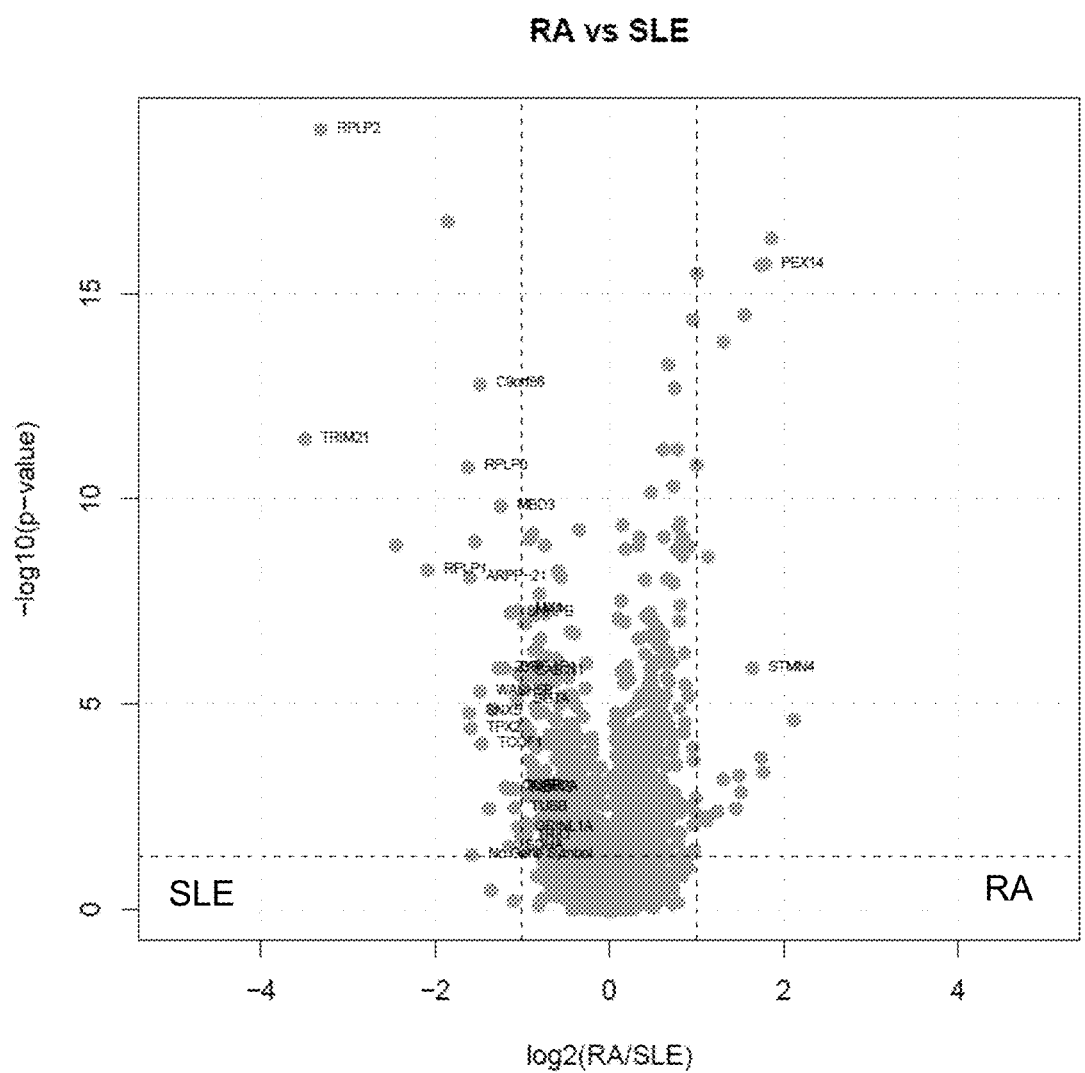
FIG. 2 shows a volcano plot of the relative antigen reactivities of the SLE patients compared to RA patients.

In order to identify antigens with which the group of all SLE patients can be distinguished from different control groups consisting of healthy samples and patients with RA, univariate statistical tests were carried out. The result of the statistical test is illustrated as a volcano plot for all 5857 antigens. In the volcano plot, the x-axis shows the relative change of the antigen reactivity in SLE patients compared with healthy controls (FIG. 1) and RA patients (FIG. 2). The y-axis presents the p-value of the statistical tests. FIGS. 1 and 2 show that specific autoantibody reactivities were found which are increased in the group of all SLE and which can distinguish both from healthy donors and from RA patients.

Example 8

Autoantibodies/Antigen Reactivities Differentiate SLE from Healthy Controls, Early Rheumatoid Arthritis and Other Autoimmune Diseases In a second screening with 6088 antigens, the antigens which differentiate between healthy controls and donors with rheumatoid arthritis were tested on patients with early rheumatoid arthritis, SSc and SPA. This is of importance in particular since patients with collagenoses and mixed collagenoses have an overlapping autoantibody profile and therefore are difficult to diagnose, particularly in the early phase.

FIG. 3 shows a volcano plot of the antigen reactivities of SLE patients against a combined group of patients with various autoimmune diseases, such as SSc, SPA, early rheumatoid arthritis, and SPA.

Following univariate statistical evaluation, a threshold value of $p<0.05$ and a 1.5 times modified reactivity compared with the control group were applied. A final list of antigen reactivities over both screens was established (Table 2).

In order to analyse the frequency of the newly identified antigens in comparison with known antigens, a threshold value of 3 standard deviations (SD) above the mean value of the healthy samples was defined.

Astonishingly, at least 4 additional antigens were identified of which the frequency in SLE patients lies above 15%. These include TMPO (19%) (SEQ ID No. 18), HNRNPA1 (26%) (SEQ ID No. 5), XRCC5 (15%) (SEQ ID No. 22) and MVP (15%) (SEQ ID No. 7).

FIG. 4 shows the frequency of 23 antigens in comparison to the healthy controls.

Table 2 summarises the identified antigen reactivities and different group comparisons.

TABLE 2

List of all antigen reactivities

| SEQ ID No. | GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 1 | 1629 | DBT | dihydrolipoamide branched chain transacylase E2 | 1 | x | | | x | | SLE vs AID |
| 2 | 1737 | DLAT | dihydrolipoamide S-acetyltransferase | 1 | x | | | | | SLE vs AID |
| 3 | 7430 | EZR | ezrin | 1 | x | | x | x | | SLE vs AID |
| 4 | 3017 | HIST1H2BD | histone cluster 1, H2bd | 1 | x | | | x | | SLE vs AID |
| 5 | 3178 | HNRNPA1 | heterogeneous nuclear ribonucleoprotein A1 | 1 | x | | | x | | SLE vs AID |
| 6 | 3181 | HNRNPA2B1 | heterogeneous nuclear ribonucleoprotein A2/B1 | 1 | x | | | x | | SLE vs AID |
| 7 | 9961 | MVP | major vault protein | 1 | x | x | x | x | | SLE vs AID |
| 8 | 6175 | RPLP0 | ribosomal protein, large, P0 | 1 | x | x | x | | | SLE vs AID |
| 9 | 6176 | RPLP1 | ribosomal protein, large, P1 | 1 | x | x | x | | x | SLE vs AID |
| 10 | 6181 | RPLP2 | ribosomal protein, large, P2 | 1 | x | x | x | | | SLE vs AID |
| 11 | 30011 | SH3KBP1 | SH3-domain kinase binding protein 1 | 1 | x | | | x | | SLE vs AID |
| 12 | 6625 | SNRNP70 | small nuclear ribonucleoprotein 70 kDa (U1) | 1 | x | | | | | SLE vs AID |
| 13 | 6628 | SNRPB | small nuclear ribonucleoprotein polypeptides B and B1 | 1 | x | x | x | | | SLE vs AID |
| 14 | 6638 | SNRPN | small nuclear ribonucleoprotein polypeptide N | 1 | x | | | | | SLE vs AID |
| 15 | 6672 | SP100 | SP100 nuclear antigen | 1 | x | | | x | | SLE vs AID |
| 16 | 6710 | SPTB | spectrin, beta, erythrocytic | 1 | x | | | x | | SLE vs AID |
| 17 | 6741 | SSB | Sjogren syndrome antigen B (autoantigen La) | 1 | x | x | | | | SLE vs AID |
| 18 | 7112 | TMPO | thymopoietin | 1 | x | | | x | x | SLE vs AID |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 19 | 6737 | TRIM21 | tripartite motif-containing 21 | 1 | x | | x | x | | SLE vs AID |
| 20 | 6738 | TROVE2 | TROVE domain family, member 2 | 1 | x | | x | | | SLE vs RA |
| 21 | 7431 | VIM | vimentin | 1 | x | | | x | | SLE vs AID |
| 22 | 7520 | XRCC5 | X-ray repair complementing defective repair in Chinese hamster cells 5 (double-strand-break rejoining) | 1 | x | | | x | | SLE vs AID |
| 23 | 7764 | ZNF217 | zinc finger protein 217 | 1 | x | | | x | | SLE vs AID |
| 24 | 64763 | ZNF574 | zinc finger protein 574 | 1 | x | | | x | | SLE vs AID |
| 25 | 148741 | ANKRD35 | ankyrin repeat domain 35 | 2 | | x | | | x | SLE vs HV |
| 26 | 84779 | ARD1B | ARD1 homolog B (*S. cerevisiae*) | 2 | | x | | | x | SLE vs AID |
| 27 | 672 | BRCA1 | breast cancer 1, early onset | 2 | | x | | | x | SLE vs HV |
| 28 | 134359 | C5orf37 | chromosome 5 open reading frame 37 | 2 | | x | | x | x | SLE vs HV |
| 29 | 9478 | CABP1 | calcium binding protein 1 | 2 | | x | | | x | SLE vs HV |
| 30 | 90557 | CCDC74A | coiled-coil domain containing 74A | 2 | | x | | | x | SLE vs HV |
| 31 | 9973 | CCS | copper chaperone for superoxide dismutase | 2 | | x | x | x | x | SLE vs AID |
| 32 | 1410 | CRYAB | crystallin, alpha B | 2 | | x | | | x | SLE vs HV |
| 33 | 55802 | DCP1A | DCP1 decapping enzyme homolog A (*S. cerevisiae*) | 2 | | x | | | x | SLE vs HV |
| 34 | 79147 | FKRP | fukutin related protein | 2 | | x | | | x | SLE vs HV |
| 35 | 26128 | KIAA1279 | KIAA1279 | 2 | | x | | | x | SLE vs HV |
| 36 | 57608 | KIAA1462 | KIAA1462 | 2 | | x | | | x | SLE vs HV |
| 37 | 1939 | LGTN | ligatin | 2 | | x | | | x | SLE vs HV |
| 38 | 84298 | LLPH | LLP homolog, long-term synaptic facilitation (*Aplysia*) | 2 | | x | | | x | SLE vs HV |
| 39 | 11253 | MAN1B1 | mannosidase, alpha, class 1B, member 1 | 2 | | x | | | x | SLE vs HV |
| 40 | 84930 | MASTL | microtubule associated serine/threonine kinase-like | 2 | | x | | | x | SLE vs HV |
| 41 | 54531 | MIER2 | mesorm induction early response 1, family member 2 | 2 | | x | x | x | x | SLE vs RA |
| 42 | 4594 | MUT | methylmalonyl Coenzyme A mutase | 2 | | x | | | x | SLE vs HV |
| 43 | 399687 | MYO18A | myosin XVIIIA | 2 | | x | | | x | SLE vs HV |
| 44 | 8883 | NAE1 | NEDD8 activating enzyme E1 subunit 1 | 2 | | x | | | x | SLE vs HV |
| 45 | 10458 | BAIAP2 | BAI1-associated protein 2 | 2 | | x | | | x | SLE vs HV |
| 46 | 4869 | NPM1 | nucleophosmin (nucleolar phosphoprotein B23, numatrin) | 2 | | x | | | x | SLE vs HV |
| 47 | 5223 | PGAM1 | phosphoglycerate mutase 1 (brain) | 2 | | x | | | x | SLE vs HV |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 48 | 11040 | PIM2 | pim-2 oncogene | 2 | x | | | | x | SLE vs HV |
| 49 | 54517 | PUS7 | pseudouridylate synthase 7 homolog (S. cerevisiae) | 2 | x | | | | x | SLE vs HV |
| 50 | 6605 | SMARCE1 | SWI/SNF related, matrix associated, actin dependent regulator of chromatin, subfamily e, member 1 | 2 | x | | | | x | SLE vs AID |
| 51 | 23635 | SSBP2 | single-stranded DNA binding protein 2 | 2 | x | | | x | x | SLE vs HV |
| 52 | 83660 | TLN2 | talin 2 | 2 | x | | | | x | SLE vs HV |
| 53 | 51673 | TPPP3 | tubulin polymerization-promoting protein family member 3 | 2 | x | | | | x | SLE vs HV |
| 54 | 7265 | TTC1 | tetratricopeptide repeat domain 1 | 2 | x | | | | x | SLE vs HV |
| 55 | 124930 | ANKRD13B | ankyrin repeat domain 13B | 3 | | | x | | | SLE vs HV |
| 56 | 160 | AP2A1 | adaptor-related protein complex 2, alpha 1 subunit | 3 | | | x | | | SLE vs HV |
| 57 | 53335 | BCL11A | B-cell CLL/lymphoma 11A (zinc finger protein) | 3 | | | x | x | | |
| 58 | 79959 | CEP76 | centrosomal protein 76 kDa | 3 | | | | | x | |
| 59 | 1153 | CIRBP | cold inducible RNA binding protein | 3 | | | x | | | SLE vs HV |
| 60 | 51084 | CRYL1 | crystallin, lambda 1 | 3 | | | | | x | |
| 61 | 55827 | DCAF6 | DDB1 and CUL4 associated factor 6 | 3 | | | x | x | x | SLE vs AID |
| 62 | 6993 | DYNLT1 | dynein, light chain, Tctex-type 1 | 3 | | | x | | | SLE vs HV |
| 63 | 283991 | FAM100B | family with sequence similarity 100, member B | 3 | | | x | | | SLE vs HV |
| 64 | 9815 | GIT2 | G protein-coupled receptor kinase interacting ArfGAP 2 | 3 | | | x | | | SLE vs HV |
| 65 | 84706 | GPT2 | glutamic pyruvate transaminase (alanine aminotransferase) 2 | 3 | | | | | x | |
| 66 | 3059 | HCLS1 | hematopoietic cell-specific Lyn substrate 1 | 3 | | | x | x | | SLE vs AID |
| 67 | 3329 | HSPD1 | heat shock 60 kDa protein 1 (chaperonin) | 3 | | | | | x | |
| 68 | 3490 | IGFBP7 | insulin-like growth factor binding protein 7 | 3 | | | x | | | SLE vs HV |
| 69 | 23392 | KIAA0368 | KIAA0368 | 3 | | | | | x | |
| 70 | 84695 | LOXL3 | lysyl oxidase-like 3 | 3 | | | | | x | |
| 71 | 4133 | MAP2 | microtubule-associated protein 2 | 3 | | | | | x | SLE vs RA |
| 72 | 6837 | MED22 | mediator complex subunit 22 | 3 | | | | | x | |
| 73 | 29079 | MED4 | mediator complex subunit 4 | 3 | | | x | x | | |
| 74 | 10933 | MORF4L1 | mortality factor 4 like 1 | 3 | | | | | x | |

TABLE 2-continued

List of all antigen reactivities

| SEQ ID No. | GeneID | Gene Symbol | Gene Name | Group | Panel SLE | Panel L. Nephr. | SLE Cluster | Statistical Test ENA-4 neg vs HV | Statistical Test L. Nephr. vs SLE | SLE vs control |
|---|---|---|---|---|---|---|---|---|---|---|
| 75 | 64963 | MRPS11 | mitochondrial ribosomal protein S11 | 3 | | | x | x | | SLE vs HV |
| 76 | 81565 | NDEL1 | nudE nuclear distribution gene E homolog (*A. nidulans*)-like 1 | 3 | | | | | x | |
| 77 | 57447 | NDRG2 | NDRG family member 2 | 3 | | | x | | | SLE vs HV |
| 78 | 4744 | NEFH | neurofilament, heavy polypeptide | 3 | | | | | x | |
| 79 | 153478 | PLEKHG4B | pleckstrin homology domain containing, family G (with RhoGef domain) member 4B [*homo sapiens* (human)] | 3 | | | x | | | SLE vs RA |
| 80 | 11054 | OGFR | opioid growth factor receptor | 3 | | | x | x | | SLE vs AID |
| 81 | 56122 | PCDHB14 | protocadherin beta 14 | 3 | | | x | | | SLE vs HV |
| 82 | 2923 | PDIA3 | protein disulfide isomerase family A, member 3 | 3 | | | x | | | SLE vs HV |
| 83 | 23646 | PLD3 | phospholipase D family, member 3 | 3 | | | x | | | SLE vs HV |
| 84 | 23759 | PPIL2 | peptidylprolyl isomerase (cyclophilin)-like 2 | 3 | | | | | x | |
| 85 | 5557 | PRIM1 | primase, DNA, polypeptide 1 (49 kDa) | 3 | | | | x | x | |
| 86 | 5682 | PSMA1 | proteasome (prosome, macropain) subunit, alpha type, 1 | 3 | | | x | | | SLE vs HV |
| 87 | 5802 | PTPRS | protein tyrosine phosphatase, receptor type, S | 3 | | | x | | | SLE vs HV |
| 88 | 81890 | QTRT1 | queuine tRNA-ribosyltransferase 1 | 3 | | | x | | | SLE vs HV |
| 89 | 116362 | RBP7 | retinol binding protein 7, cellular | 3 | | | x | | | SLE vs HV |
| 90 | 10287 | RGS19 | regulator of G-protein signaling 19 | 3 | | | x | x | | |
| 91 | 83642 | RP3-402G11.5 | selenoprotein O | 3 | | | x | | | SLE vs HV |
| 92 | 6389 | SDHA | succinate dehydrogenase complex, subunit A, flavoprotein (Fp) | 3 | | | x | x | | SLE vs AID |
| 93 | 54437 | SEMA5B | sema domain, seven thrombospondin repeats (type 1 and type 1-like), transmembrane domain (TM) and short cytoplasmic domain, (semaphorin) 5B | 3 | | | | | x | |
| 94 | 59343 | SENP2 | SUMO1/sentrin/SMT3 specific peptidase 2 | 3 | | | x | | | SLE vs HV |
| 95 | 6629 | SNRPB2 | small nuclear ribonucleoprotein polypeptide B" | 3 | | | x | | | SLE vs AID |
| 96 | 27131 | SNX5 | sorting nexin 5 | 3 | | | x | | | SLE vs HV |

TABLE 2-continued

List of all antigen reactivities

| SEQ ID No. | Gene GeneID | Gene Symbol | Gene Name | Group | Panel SLE | L. Nephr. | SLE Cluster | Statistical Test ENA-4 neg vs HV | L. Nephr. vs SLE | SLE vs control |
|---|---|---|---|---|---|---|---|---|---|---|
| 97 | 9021 | SOCS3 | suppressor of cytokine signaling 3 | 3 | | | | x | x | SLE vs HV |
| 98 | 3925 | STMN1 | stathmin 1 | 3 | | | x | | | SLE vs HV |
| 99 | 81551 | STMN4 | stathmin-like 4 | 3 | | | x | | | SLE vs HV |
| 100 | 27097 | TAF5L | TAF5-like RNA polymerase II, p300/CBP-associated factor (PCAF)-associated factor, 65 kDa | 3 | | | x | | | SLE vs HV |
| 101 | 79921 | TCEAL4 | transcription elongation factor A (SII)-like 4 | 3 | | | x | | | SLE vs HV |
| 102 | 10040 | TOM1L1 | target of myb1 (chicken)-like 1 | 3 | | | x | | | SLE vs HV |
| 103 | 22974 | TPX2 | TPX2, microtubule-associated, homolog (*Xenopus laevis*) | 3 | | | x | | | SLE vs HV |
| 104 | 51567 | TTRAP | TRAF and TNF receptor associated protein | 3 | | | | | x | |
| 105 | 8615 | USO1 | USO1 homolog, vesicle docking protein (yeast) | 3 | | | | x | x | |
| 106 | 10869 | USP19 | ubiquitin specific peptidase 19 | 3 | | | x | | | SLE vs RA |
| 107 | 29761 | USP25 | ubiquitin specific peptidase 25 | 3 | | | | | x | |
| 108 | 375690 | WASH5P | WAS protein family homolog 5 pseudogene | 3 | | | x | x | | SLE vs HV |
| 109 | 10413 | YAP1 | Yes-associated protein 1, 65 kDa | 3 | | | | | x | |
| 110 | 653121 | ZBTB8A | zinc finger and BTB domain containing 8A | 3 | | | x | x | | SLE vs HV |
| 111 | 55311 | ZNF444 | zinc finger protein 444 | 3 | | | | | x | |
| 112 | 29 | ABR | active BCR-related gene | 4 | | | | x | | SLE vs AID |
| 113 | 118 | ADD1 | adducin 1 (alpha) | 4 | | | | x | | SLE vs AID |
| 114 | 55256 | ADI1 | acireductone dioxygenase 1 | 4 | | | | x | | SLE vs HV |
| 115 | 9255 | AIMP1 | aminoacyl tRNA synthetase complex-interacting multifunctional protein 1 | 4 | | | | x | | |
| 116 | 54522 | ANKRD16 | ankyrin repeat domain 16 | 4 | | | | x | | SLE vs HV |
| 117 | 348 | APOE | apolipoprotein E | 4 | | | | x | | SLE vs HV |
| 118 | 64333 | ARHGAP9 | Rho GTPase activating protein 9 | 4 | | | | x | | SLE vs HV |
| 119 | 22994 | AZI1 | 5-azacytidine induced 1 | 4 | | | | x | | SLE vs HV |
| 120 | 55971 | BAIAP2L1 | BAI1-associated protein 2-like 1 | 4 | | | | x | | |
| 121 | 7919 | BAT1 | HLA-B associated transcript 1 | 4 | | | | x | | SLE vs RA |
| 122 | 6046 | BRD2 | bromodomain containing 2 | 4 | | | | x | | |
| 123 | 56912 | C11orf60 | chromosome 11 open reading frame 60 | 4 | | | | x | | |
| 124 | 79415 | C17orf62 | chromosome 17 open reading frame 62 | 4 | | | | x | | |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 125 | 51300 | C3orf1 | chromosome 3 open reading frame 1 | 4 | | | | x | | SLE vs RA |
| 126 | 128866 | CHMP4B | chromatin modifying protein 4B | 4 | | | | x | | SLE vs AID |
| 127 | 23152 | CIC | capicua homolog (*Drosophila*) | 4 | | | | x | | SLE vs AID |
| 128 | 10970 | CKAP4 | cytoskeleton-associated protein 4 | 4 | | | | x | | SLE vs HV |
| 129 | 23122 | CLASP2 | cytoplasmic linker associated protein 2 | 4 | | | | x | | SLE vs HV |
| 130 | 1311 | COMP | cartilage oligomeric matrix protein | 4 | | | | x | | |
| 131 | 7812 | CSDE1 | cold shock domain containing E1, RNA-binding | 4 | | | | x | | SLE vs HV |
| 132 | 8642 | DCHS1 | dachsous 1 (*Drosophila*) | 4 | | | | x | | SLE vs AID |
| 133 | 9909 | DENND4B | DENN/MADD domain containing 4B | 4 | | | | x | x | |
| 134 | 1743 | DLST | dihydrolipoamide S-succinyltransferase (E2 component of 2-oxo-glutarate complex) | 4 | | | | x | | |
| 135 | 84444 | DOT1L | DOT1-like, histone H3 methyltransferase (*S. cerevisiae*) | 4 | | | | x | | |
| 136 | 51143 | DYNC1LI1 | dynein, cytoplasmic 1, light intermediate chain 1 | 4 | | | | x | | SLE vs HV |
| 137 | 51011 | FAHD2A | fumarylacetoacetate hydrolase domain containing 2A | 4 | | | | x | | |
| 138 | 92689 | FAM114A1 | family with sequence similarity 114, member A1 | 4 | | | | x | | |
| 139 | 54463 | FAM134B | family with sequence similarity 134, member B | 4 | | | | x | | |
| 140 | 100129583 | FAM47E | family with sequence similarity 47, member E | 4 | | | | x | | SLE vs HV |
| 141 | 93611 | FBXO44 | F-box protein 44 | 4 | | | | x | | |
| 142 | 60681 | FKBP10 | FK506 binding protein 10, 65 kDa | 4 | | | | x | | SLE vs AID |
| 143 | 23360 | FNBP4 | formin binding protein 4 | 4 | | | | x | | SLE vs HV |
| 144 | 2300 | FOXL1 | forkhead box L1 | 4 | | | | x | | SLE vs HV |
| 145 | 64689 | GORASP1 | golgi reassembly stacking protein 1, 65 kDa | 4 | | | | x | | SLE vs AID |
| 146 | 2934 | GSN | gelsolin (amyloidosis, Finnish type) | 4 | | | | x | | SLE vs HV |
| 147 | 3039 | HBA1 | hemoglobin, alpha 1 | 4 | | | | x | | |
| 148 | 3040 | HBA2 | hemoglobin, alpha 2 | 4 | | | | x | | |
| 149 | 388585 | HES5 | hairy and enhancer of split 5 (*Drosophila*) | 4 | | | | x | | |
| 150 | 10525 | HYOU1 | hypoxia up-regulated 1 | 4 | | | | x | | |
| 151 | 3608 | ILF2 | interleukin enhancer binding factor 2, 45 kDa | 4 | | | | x | | SLE vs RA |
| 152 | 23135 | KDM6B | lysine (K)-specific demethylase 6B | 4 | | | | x | | SLE vs AID |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 153 | 56243 | KIAA1217 | KIAA1217 | 4 | | | | x | | SLE vs HV |
| 154 | 57662 | KIAA1543 | KIAA1543 | 4 | | | | x | | |
| 155 | 57498 | KIDINS220 | kinase D-interacting substrate, 220 kDa | 4 | | | | x | | |
| 156 | 3855 | KRT7 | keratin 7 | 4 | | | | x | | SLE vs HV |
| 157 | 729970 | LOC729970 | similar to hCG2028352 | 4 | | | | x | | |
| 158 | 9935 | MAFB | v-maf musculoaponeurotic fibrosarcoma oncogene homolog B (avian) | 4 | | | | x | | |
| 159 | 23764 | MAFF | v-maf musculoaponeurotic fibrosarcoma oncogene homolog F (avian) | 4 | | | | x | | SLE vs HV |
| 160 | 22924 | MAPRE3 | microtubule-associated protein, RP/EB family, member 3 | 4 | | | | x | | |
| 161 | 8079 | MLF2 | myeloid leukemia factor 2 | 4 | | | | x | | |
| 162 | 4676 | NAP1L4 | nucleosome assembly protein 1-like 4 | 4 | | | | x | | |
| 163 | 4688 | NCF2 | neutrophil cytosolic factor 2 | 4 | | | | x | | SLE vs HV |
| 164 | 4780 | NFE2L2 | nuclear factor (erythroid-derived 2)-like 2 | 4 | | | | x | | |
| 165 | 79840 | NHEJ1 | nonhomologous end-joining factor 1 | 4 | | | | x | x | |
| 166 | 22861 | NLRP1 | NLR family, pyrin domain containing 1 | 4 | | | | x | | SLE vs HV |
| 167 | 65009 | NDRG4 | NDRG family member 4 | 4 | | | | x | | SLE vs HV |
| 168 | 4841 | NONO | non-POU domain containing, octamer-binding | 4 | | | | x | | SLE vs AID |
| 169 | 29982 | NRBF2 | nuclear receptor binding factor 2 | 4 | | | | x | | SLE vs AID |
| 170 | 8439 | NSMAF | neutral sphingomyelinase (N-SMase) activation associated factor | 4 | | | | x | | SLE vs HV |
| 171 | 4926 | NUMA1 | nuclear mitotic apparatus protein 1 | 4 | | | | x | | SLE vs RA |
| 172 | 84759 | PCGF1 | polycomb group ring finger 1 | 4 | | | | x | | |
| 173 | 84306 | PDCD2L | programmed cell death 2-like | 4 | | | | x | | SLE vs HV |
| 174 | 5195 | PEX14 | peroxisomal biogenesis factor 14 | 4 | | | | x | | SLE vs HV |
| 175 | 9091 | PIGQ | phosphatidylinositol glycan anchor biosynthesis, class Q | 4 | | | | x | | SLE vs RA |
| 176 | 100137049 | PLA2G4B | phospholipase A2, group IVB (cytosolic) | 4 | | | | x | | SLE vs RA |
| 177 | 10226 | PLIN3 | perilipin 3 | 4 | | | | x | | |
| 178 | 5373 | PMM2 | phosphomannomutase 2 | 4 | | | | x | | |
| 179 | 10450 | PPIE | peptidylprolyl isomerase E (cyclophilin E) | 4 | | | | x | | |

TABLE 2-continued

List of all antigen reactivities

| SEQ ID No. | Gene GeneID | Gene Symbol | Gene Name | Group | Panel SLE | L. Nephr. | SLE Cluster | Statistical Test ENA-4 neg vs HV | L. Nephr. vs SLE | SLE vs control |
|---|---|---|---|---|---|---|---|---|---|---|
| 180 | 5694 | PSMB6 | proteasome (prosome, macropain) subunit, beta type, 6 | 4 | | | | x | | |
| 181 | 22913 | RALY | RNA binding protein, autoantigenic (hnRNP-associated with lethal yellow homolog (mouse)) | 4 | | | | x | | SLE vs HV |
| 182 | 8241 | RBM10 | RNA binding motif protein 10 | 4 | | | | x | | |
| 183 | 9904 | RBM19 | RNA binding motif protein 19 | 4 | | | | x | | SLE vs HV |
| 184 | 9743 | RICS | Rho GTPase-activating protein | 4 | | | | x | | |
| 185 | 8780 | RIOK3 | RIO kinase 3 (yeast) | 4 | | | | x | | |
| 186 | 8578 | SCARF1 | scavenger receptor class F, member 1 | 4 | | | | x | | SLE vs AID |
| 187 | 23513 | SCRIB | scribbled homolog (*Drosophila*) | 4 | | | | x | | SLE vs HV |
| 188 | 644096 | SDHAF1 | succinate dehydrogenase complex assembly factor 1 | 4 | | | | x | | SLE vs RA |
| | 57794 | SF4 | splicing factor 4 | 4 | | | | x | | SLE vs RA |
| 189 | 9814 | SFI1 | Sfi1 homolog, spindle assembly associated (yeast) | 4 | | | | x | | |
| 190 | 6421 | SFPQ | splicing factor proline/glutamine-rich (polypyrimidine tract binding protein associated) | 4 | | | | x | | SLE vs AID |
| 191 | 83442 | SH3BGRL3 | SH3 domain binding glutamic acid-rich protein like 3 | 4 | | | | x | | |
| 192 | 6461 | SHB | Src homology 2 domain containing adaptor protein B | 4 | | | | x | | SLE vs AID |
| 193 | 23381 | SMG5 | Smg-5 homolog, nonsense mediated mRNA decay factor (*C. elegans*) | 4 | | | | x | | SLE vs HV |
| 194 | 112574 | SNX18 | sorting nexin 18 | 4 | | | | x | | SLE vs HV |
| 195 | 84501 | SPIRE2 | spire homolog 2 (*Drosophila*) | 4 | | | | x | | SLE vs HV |
| 196 | 54961 | SSH3 | slingshot homolog 3 (*Drosophila*) | 4 | | | | x | | SLE vs AID |
| 197 | 9263 | STK17A | serine/threonine kinase 17a | 4 | | | | x | | |
| 198 | 51111 | SUV420H1 | suppressor of variegation 4-20 homolog 1 (*Drosophila*) | 4 | | | | x | | |
| 199 | 6902 | TBCA | tubulin folding cofactor A | 4 | | | | x | | |
| 200 | 7024 | TFCP2 | transcription factor CP2 | 4 | | | | x | | SLE vs HV |
| 201 | 7030 | TFE3 | transcription factor binding to IGHM enhancer 3 | 4 | | | | x | | SLE vs HV |
| 202 | 90326 | THAP3 | THAP domain containing, apoptosis associated protein 3 | 4 | | | | x | | SLE vs AID |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 203 | 10043 | TOM1 | target of myb1 (chicken) | 4 | | | | x | | |
| 204 | 7168 | TPM1 | tropomyosin 1 (alpha) | 4 | | | | x | | SLE vs HV |
| 205 | 54952 | TRNAU1AP | tRNA selenocysteine 1 associated protein 1 | 4 | | | | x | | |
| 206 | 26140 | TTLL3 | tubulin tyrosine ligase-like family, member 3 | 4 | | | | x | | |
| 207 | 7371 | UCK2 | uridine-cytidine kinase 2 | 4 | | | | x | | SLE vs HV |
| 208 | 9277 | WDR46 | WD repeat domain 46 | 4 | | | | x | | SLE vs HV |
| 209 | 55100 | WDR70 | WD repeat domain 70 | 4 | | | | x | | SLE vs AID |
| 210 | 23038 | WDTC1 | WD and tetratricopeptide repeats 1 | 4 | | | | x | | SLE vs HV |
| 211 | 9831 | ZNF623 | zinc finger protein 623 | 4 | | | | x | | |
| 212 | 79364 | ZXDC | ZXD family zinc finger C | 4 | | | | x | x | SLE vs AID |
| 213 | 7791 | ZYX | zyxin | 4 | | | | x | | SLE vs AID |
| 214 | 55964 | SEPT3 | septin 3 | 5 | | | | | x | |
| 215 | 5413 | SEPT5 | septin 5 | 5 | | | | | x | |
| 216 | 26574 | AATF | apoptosis antagonizing transcription factor | 5 | | | | | x | |
| 217 | 91703 | ACY3 | aspartoacylase (aminocyclase) 3 | 5 | | | | | x | |
| 218 | 9509 | ADAMTS2 | ADAM metallopeptidase with thrombospondin type 1 motif, 2 | 6 | | | | | | SLE vs RA |
| 219 | 10939 | AFG3L2 | AFG3 ATPase family gene 3-like 2 (yeast) | 6 | | | | | | SLE vs HV |
| 220 | 1646 | AKR1C2 | aldo-keto reductase family 1, member C2 (dihydrodiol dehydrogenase 2; bile acid binding protein; 3-alpha hydroxysteroid dehydrogenase, type III) | 6 | | | | | | SLE vs RA |
| 221 | 267 | AMFR | autocrine motility factor receptor | 6 | | | | | | SLE vs RA |
| 222 | 10777 | ARPP-21 | cyclic AMP-regulated phosphoprotein, 21 kD | 6 | | | | | | SLE vs RA |
| 223 | 421 | ARVCF | armadillo repeat gene deletes in velocardiofacial syndrome | 6 | | | | | | SLE vs RA |
| 224 | 80150 | ASRGL1 | asparaginase like 1 | 6 | | | | | | SLE vs RA |
| 225 | 539 | ATP5O | ATP synthase, H+ transporting, mitochondrial F1 complex, O subunit | 6 | | | | | | SLE vs RA |
| 226 | 79870 | BAALC | brain and acute leukemia, cytoplasmic | 6 | | | | | | SLE vs RA |
| 227 | 9531 | BAG3 | BCL2-associated athanogene 3 | 5 | | | | | x | |
| 228 | 9275 | BCL7B | B-cell CLL/lymphoma 7B | 6 | | | | | | SLE vs HV |

TABLE 2-continued

List of all antigen reactivities

| SEQ ID No. | GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 229 | 55108 | BSDC1 | BSD domain containing 1 | 6 | | | | | | SLE vs AID |
| 230 | 54934 | C12orf41 | chromosome 12 open reading frame 41 | 6 | | | | | | SLE vs RA |
| 231 | 55049 | C19orf60 | chromosome 19 open reading frame 60 | 6 | | | | | | SLE vs RA |
| 232 | 388799 | C20orf107 | chromosome 20 open reading frame 107 | 5 | | | | | x | |
| 233 | 149840 | C20orf196 | chromosome 20 open reading frame 196 | 6 | | | | | | SLE vs RA |
| 234 | 51507 | C20orf43 | chromosome 20 open reading frame 43 | 6 | | | | | | SLE vs RA |
| 235 | 55684 | C9orf86 | chromosome 9 open reading frame 86 | 6 | | | | | | SLE vs HV |
| 236 | 23523 | CABIN1 | calcineurin binding protein 1 | 6 | | | | | | SLE vs RA |
| 237 | 157922 | CAMSAP1 | calmodulin regulated spectrin-associated protein 1 | 6 | | | | | | SLE vs RA |
| 238 | 23624 | CBLC | Cas-Br-M (murine) ecotropic retroviral transforming sequence c | 6 | | | | | | SLE vs HV |
| 239 | 124808 | CCDC43 | coiled-coil domain containing 43 | 6 | | | | | | SLE vs RA |
| 240 | 100133941 | CD24 | CD24 molecule | 5 | | | | | x | |
| 241 | 11140 | CDC37 | cell division cycle 37 homolog (*S. cerevisiae*) | 6 | | | | | | SLE vs RA |
| 242 | 10153 | CEBPZ | CCAAT/enhancer binding protein (C/EBP), zeta | 6 | | | | | | SLE vs RA |
| 243 | 51510 | CHMP5 | chromatin modifying protein 5 | 6 | | | | | | SLE vs RA |
| 244 | 63922 | CHTF18 | CTF18, chromosome transmission fidelity factor 18 homolog (*S. cerevisiae*) | 5 | | | | | x | |
| 245 | 51727 | CMPK1 | cytidine monophosphate (UMP-CMP) kinase 1, cytosolic | 6 | | | | | | SLE vs AID |
| 246 | 64708 | COPS7B | COP9 constitutive photomorphogenic homolog subunit 7B (*Arabidopsis*) | 5 | | | | | x | |
| 247 | 51117 | COQ4 | coenzyme Q4 homolog (*S. cerevisiae*) | 6 | | | | | | SLE vs RA |
| 248 | 27254 | CSDC2 | cold shock domain containing C2, RNA binding | 5 | | | | | x | |
| 249 | 162989 | DEDD2 | death effector domain containing 2 | 6 | | | | | | SLE vs RA |
| 250 | 9704 | DHX34 | DEAH (Asp-Glu-Ala-His) box polypeptide 34 | 6 | | | | | | SLE vs RA |
| 251 | 55837 | EAPP | E2F-associated phosphoprotein | 6 | | | | | | SLE vs RA |
| 252 | 1915 | EEF1A1 | eukaryotic translation elongation factor 1 alpha 1 | 6 | | | | | | SLE vs RA |
| 253 | 1936 | EEF1D | eukaryotic translation elongation factor 1 delta (guanine nucleotide exchange protein) | 6 | | | | | | SLE vs RA |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 254 | 8669 | EIF3J | eukaryotic translation initiation factor 3, subunit J | 6 | | | | | | SLE vs RA |
| 255 | 55740 | ENAH | enabled homolog (*Drosophila*) | 6 | | | | | | SLE vs HV |
| 256 | 2023 | ENO1 | enolase 1, (alpha) | 6 | | | | | | SLE vs HV |
| 257 | 11124 | FAF1 | Fas (TNFRSF6) associated factor 1 | 5 | | | | | x | |
| 258 | 11170 | FAM107A | family with sequence similarity 107, member A | 6 | | | | | | SLE vs HV |
| 259 | 84908 | FAM136A | family with sequence similarity 136, member A | 6 | | | | | | SLE vs RA |
| 260 | 10144 | FAM13A | family with sequence similarity 13, member A | 6 | | | | | | SLE vs RA |
| 261 | 26017 | FAM32A | family with sequence similarity 32, member A | 6 | | | | | | SLE vs HV |
| 262 | 64762 | FAM59A | family with sequence similarity 59, member A | 6 | | | | | | SLE vs RA |
| 263 | 150946 | FAM59B | family with sequence similarity 59, member B | 6 | | | | | | SLE vs HV |
| 264 | 83706 | FERMT3 | fermitin family homolog 3 (*Drosophila*) | 6 | | | | | | SLE vs RA |
| 265 | 23307 | FKBP15 | FK506 binding protein 15, 133 kDa | 6 | | | | | | SLE vs HV |
| 266 | 2670 | GFAP | glial fibrillary acidic protein | 6 | | | | | | SLE vs RA |
| 267 | 51031 | GLOD4 | glyoxalase domain containing 4 | 6 | | | | | | SLE vs AID |
| 268 | 81488 | GRINL1A | glutamate receptor, ionotropic, N-methyl D-aspartate-like 1A | 6 | | | | | | SLE vs RA |
| 269 | 2922 | GRP | gastrin-releasing peptide | 6 | | | | | | SLE vs RA |
| 270 | 2935 | GSPT1 | G1 to S phase transition 1 | 6 | | | | | | SLE vs RA |
| 271 | 93323 | HAUS8 | HAUS augmin-like complex, subunit 8 | 6 | | | | | | SLE vs HV |
| 272 | 3054 | HCFC1 | host cell factor C1 (VP16-accessory protein) | 6 | | | | | | SLE vs AID |
| 273 | 3069 | HDLBP | high density lipoprotein binding protein | 6 | | | | | | SLE vs RA |
| 274 | 3184 | HNRNPD | heterogeneous nuclear ribonucleoprotein D (AU-rich element RNA binding protein 1, 37 kDa) | 6 | | | | | | SLE vs HV |
| 275 | 3320 | HSP90AA1 | heat shock protein 90 kDa alpha (cytosolic), class A member 1 | 6 | | | | | | SLE vs RA |
| 276 | 7184 | HSP90B1 | heat shock protein 90 kDa beta (Grp94), member 1 | 6 | | | | | | SLE vs RA |
| 277 | 3304 | HSPA1B | heat shock 70 kDa protein 1B | 6 | | | | | | SLE vs RA |
| 278 | 3315 | HSPB1 | heat shock 27 kDa protein 1 | 4 | | | | x | x | SLE vs RA |
| 279 | 5654 | HTRA1 | HtrA serine peptidase 1 | 6 | | | | | | SLE vs RA |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 280 | 3382 | ICA1 | islet cell autoantigen 1, 69 kDa | 6 | | | | | | SLE vs RA |
| 281 | 3550 | IK | IK cytokine, down-regulator of HLA II | 6 | | | | | | SLE vs HV |
| 282 | 80895 | ILKAP | integrin-linked kinase-associated serine/threonine phosphatase 2C | 6 | | | | | | SLE vs RA |
| 283 | 84162 | KIAA1109 | KIAA1109 | 6 | | | | | | SLE vs AID |
| 284 | 3856 | KRT8 | keratin 8 | 6 | | | | | | SLE vs RA |
| 285 | 23367 | LARP1 | La ribonucleoprotein domain family, member 1 | 6 | | | | | | SLE vs AID |
| 286 | 4001 | LMNB1 | lamin B1 | 6 | | | | | | SLE vs RA |
| 287 | 79888 | LPCAT1 | lysophosphatidylcho-line acyltransferase 1 | 5 | | | | | x | SLE vs HV |
| 288 | 10916 | MAGED2 | melanoma antigen family D, 2 | 5 | | | | | x | |
| 289 | 55700 | MAP7D1 | MAP7 domain containing 1 | 6 | | | | | | SLE vs RA |
| 290 | 5602 | MAPK10 | mitogen-activated protein kinase 10 | 6 | | | | | | SLE vs HV |
| 291 | 22919 | MAPRE1 | microtubule-associated protein, RP/EB family, member 1 | 6 | | | | | | SLE vs AID |
| 292 | 4137 | MAPT | microtubule-associated protein tau | 6 | | | | | | SLE vs RA |
| 293 | 23139 | MAST2 | microtubule associated serine/threonine kinase 2 | 6 | | | | | | SLE vs RA |
| 294 | 53615 | MBD3 | methyl-CpG binding domain protein 3 | 6 | | | | | | SLE vs RA |
| 295 | 56922 | MCCC1 | methylcrotonoyl-Coenzyme A carboxylase 1 (alpha) | 6 | | | | | | SLE vs HV |
| 296 | 1953 | MEGF6 | multiple EGF-like-domains 6 | 6 | | | | | | SLE vs RA |
| 297 | 4302 | MLLT6 | myeloid/lymphoid or mixed-lineage leukemia (trithorax homolog, Drosophila); translocated to, 6 | 6 | | | | | | SLE vs RA |
| 298 | 10200 | MPHOSPH6 | M-phase phosphoprotein 6 | 6 | | | | | | SLE vs RA |
| 299 | 10240 | MRPS31 | mitochondrial ribosomal protein S31 | 6 | | | | | | SLE vs HV |
| 300 | 84939 | MUM1 | melanoma associated antigen (mutated) 1 | 5 | | | | | x | |
| 301 | 4599 | MX1 | myxovirus (influenza virus) resistance 1, interferon-inducible protein p78 (mouse) | 6 | | | | | | SLE vs RA |
| 302 | 4716 | NDUFB10 | NADH dehydrogenase (ubiquinone) 1 beta subcomplex, 10, 22 kDa | 6 | | | | | | SLE vs RA |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 303 | 4796 | NFKBIL2 | nuclear factor of kappa light polypeptide gene enhancer in B-cells inhibitor-like 2 | 6 | | | | | | SLE vs HV |
| 304 | 11188 | NISCH | nischarin | 6 | | | | | | SLE vs RA |
| 305 | 10381 | TUBB3 | tubulin, beta 3 class III | 6 | | | | | | SLE vs RA |
| 306 | 8602 | NOP14 | NOP14 nucleolar protein homolog (yeast) | 6 | | | | | | SLE vs RA |
| 307 | 9722 | NOS1AP | nitric oxide synthase 1 (neuronal) adaptor protein | 6 | | | | | | SLE vs RA |
| 308 | 29959 | NRBP1 | nuclear receptor binding protein 1 | 5 | | | | | x | |
| 309 | 142 | PARP1 | poly (ADP-ribose) polymerase 1 | 6 | | | | | | SLE vs RA |
| 310 | 5091 | PC | pyruvate carboxylase | 6 | | | | | | SLE vs RA |
| 311 | 23024 | PDZRN3 | PDZ domain containing ring finger 3 | 6 | | | | | | SLE vs RA |
| 312 | 8682 | PEA15 | phosphoprotein enriched in astrocytes 15 | 6 | | | | | | SLE vs RA |
| 313 | 5187 | PER1 | period homolog 1 (*Drosophila*) | 6 | | | | | | SLE vs HV |
| 314 | 57649 | PHF12 | PHD finger protein 12 | 5 | | | | | x | |
| 315 | 26227 | PHGDH | phosphoglycerate dehydrogenase | 5 | | | | | x | |
| 316 | 1263 | PLK3 | polo-like kinase 3 (*Drosophila*) | 6 | | | | | | SLE vs RA |
| 317 | 23654 | PLXNB2 | plexin B2 | 6 | | | | | | SLE vs RA |
| 318 | 56902 | PNO1 | partner of NOB1 homolog (*S. cerevisiae*) | 6 | | | | | | SLE vs RA |
| 319 | 5479 | PPIB | peptidylprolyl isomerase B (cyclophilin B) | 6 | | | | | | SLE vs HV |
| 320 | 56978 | PRDM8 | PR domain containing 8 | 6 | | | | | | SLE vs HV |
| 321 | 55119 | PRPF38B | PRP38 pre-mRNA processing factor 38 (yeast) domain containing B | 6 | | | | | | SLE vs RA |
| 322 | 5764 | PTN | pleiotrophin | 6 | | | | | | SLE vs HV |
| 323 | 5819 | PVRL2 | poliovirus receptor-related 2 (herpesvirus entry mediator B) | 5 | | | | | x | |
| 324 | 5831 | PYCR1 | pyrroline-5-carboxylate reductase 1 | 6 | | | | | | SLE vs RA |
| 325 | 65997 | RASL11B | RAS-like, family 11, member B | 6 | | | | | | SLE vs RA |
| 326 | 55658 | RNF126 | ring finger protein 126 | 6 | | | | | | SLE vs AID |
| 327 | 115992 | RNF166 | ring finger protein 166 | 6 | | | | | | SLE vs HV |
| 328 | 9025 | RNF8 | ring finger protein 8 | 6 | | | | | | SLE vs HV |
| 329 | 6092 | ROBO2 | roundabout, axon guidance receptor, homolog 2 (*Drosophila*) | 5 | | | | | x | |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 330 | 64221 | ROBO3 | roundabout, axon guidance receptor, homolog 3 (*Drosophila*) | 5 | | | | | x | |
| 331 | 4736 | RPL10A | ribosomal protein L10a | 6 | | | | | | SLE vs RA |
| 332 | 6152 | RPL24 | ribosomal protein L24 | 6 | | | | | | SLE vs RA |
| 333 | 148418 | SAMD13 | sterile alpha motif domain containing 13 | 6 | | | | | | SLE vs HV |
| 334 | 57147 | SCYL3 | SCY1-like 3 (*S. cerevisiae*) | 6 | | | | | | SLE vs AID |
| 335 | 6382 | SDC1 | syndecan 1 | 6 | | | | | | SLE vs RA |
| 336 | 91461 | SGK493 | protein kinase-like protein SgK493 | 5 | | | | | x | |
| 337 | 6449 | SGTA | small glutamine-rich tetratricopeptide repeat (TPR)-containing, alpha | 6 | | | | | | SLE vs HV |
| 338 | 9627 | SNCAIP | synuclein, alpha interacting protein | 5 | | | | | x | |
| 339 | 9552 | SPAG7 | sperm associated antigen 7 | 6 | | | | | | SLE vs RA |
| 340 | 57522 | SRGAP1 | SLIT-ROBO Rho GTPase activating protein 1 | 6 | | | | | | SLE vs RA |
| 341 | 6744 | SSFA2 | sperm specific antigen 2 | 6 | | | | | | SLE vs RA |
| 342 | 6487 | ST3GAL3 | ST3 beta-galactoside alpha-2,3-sialyltransferase 3 | 6 | | | | | | SLE vs RA |
| 343 | 23345 | SYNE1 | spectrin repeat containing, nuclear envelope 1 | 6 | | | | | | SLE vs AID |
| 344 | 6879 | TAF7 | TAF7 RNA polymerase II, TATA box binding protein (TBP)-associated factor, 55 kDa | 6 | | | | | | SLE vs HV |
| 345 | 6895 | TARBP2 | TAR (HIV-1) RNA binding protein 2 | 6 | | | | | | SLE vs RA |
| 346 | 6949 | TCOF1 | Treacher Collins-Franceschetti syndrome 1 | 6 | | | | | | SLE vs RA |
| 347 | 7980 | TFPI2 | tissue factor pathway inhibitor 2 | 5 | | | | | x | |
| 348 | 56674 | TMEM9B | TMEM9 domain family, member B | 6 | | | | | | SLE vs RA |
| 349 | 11189 | TNRC4 | trinucleotide repeat containing 4 | 5 | | | | | x | |
| 350 | 10155 | TRIM28 | tripartite motif-containing 28 | 6 | | | | | | SLE vs HV |
| 351 | 7204 | TRIO | triple functional domain (PTPRF interacting) | 6 | | | | | | SLE vs RA |
| 352 | 203068 | TUBB | tubulin, beta | 6 | | | | | | SLE vs RA |
| 353 | 7280 | TUBB2A | tubulin, beta 2A | 6 | | | | | | SLE vs RA |
| 354 | 27229 | TUBGCP4 | tubulin, gamma complex associated protein 4 | 6 | | | | | | SLE vs RA |
| 355 | 10422 | UBAC1 | UBA domain containing 1 | 6 | | | | | | SLE vs RA |
| 356 | 7316 | UBC | ubiquitin C | 6 | | | | | | SLE vs RA |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 357 | 55585 | UBE2Q1 | ubiquitin-conjugating enzyme E2Q family member 1 | 6 | | | | | | SLE vs HV |
| 358 | 65109 | UPF3B | UPF3 regulator of nonsense transcripts homolog B (yeast) | 5 | | | | | x | |
| 359 | 7378 | UPP1 | uridine phosphorylase 1 | 6 | | | | | | SLE vs AID |
| 360 | 64856 | VWA1 | von Willebrand factor A domain containing 1 | 6 | | | | | | SLE vs RA |
| 361 | 55884 | WSB2 | WD repeat and SOCS box-containing 2 | 5 | | | | | x | |
| 362 | 9877 | ZC3H11A | zinc finger CCCH-type containing 11A | 5 | | | | | x | |
| 363 | 55854 | ZC3H15 | zinc finger CCCH-type containing 15 | 6 | | | | | | SLE vs HV |
| 364 | 7592 | ZNF41 | zinc finger protein 41 | 6 | | | | | | SLE vs RA |
| 365 | 170959 | ZNF431 | zinc finger protein 431 | 6 | | | | | | SLE vs RA |
| 366 | 146542 | ZNF688 | zinc finger protein 688 | 6 | | | | | | SLE vs RA |
| 367 | 4670 | HNRNPM | heterogeneous nuclear ribonucleoprotein M | 7 | | | | | | SLE vs HV |
| 368 | 10540 | DCTN2 | dynactin 2 (p50) | 7 | | | | | | SLE vs HV |
| 369 | 10938 | EHD1 | EH-domain containing 1 | 7 | | | | | | SLE vs HV |
| 370 | 38 | ACAT1 | Acetyl-Coenzyme A acetyltransferase 1 (acetoacetyl Coenzyme A thiolase) | 7 | | | | | | SLE vs HV |
| 371 | 684 | BST2 | bone marrow stromal cell antigen 2 | 7 | | | | | | SLE vs HV |
| 372 | 1058 | CENPA | centromere protein A | 7 | | | | | | SLE vs HV |
| 373 | 1665 | DHX15 | DEAH (Asp-Glu-Ala-His) box polypeptide 15 | 7 | | | | | | SLE vs HV |
| 374 | 3092 | HIP1 | Huntingtin interacting protein 1 | 7 | | | | | | SLE vs HV |
| 375 | 3336 | HSPE1 | heat shock 10 kDa protein 1 (chaperonin 10) | 7 | | | | | | SLE vs HV |
| 376 | 5455 | POU3F3 | POU class 3 homeobox 3 | 7 | | | | | | SLE vs HV |
| 377 | 5918 | RARRES1 | retinoic acid receptor responder (tazarotene induced) 1 | 7 | | | | | | SLE vs HV |
| 378 | 6136 | RPL12 | ribosomal protein L12 | 7 | | | | | | SLE vs HV |
| 379 | 6626 | SNRPA | small nuclear ribonucleoprotein polypeptide A | 7 | | | | | | SLE vs HV |
| 380 | 6631 | SNRPC | small nuclear ribonucleoprotein polypeptide C | 7 | | | | | | SLE vs HV |
| 381 | 6757 | SSX2 | synovial sarcoma, X breakpoint 2 | 7 | | | | | | SLE vs HV |
| 382 | 9788 | MTSS1 | metastasis suppressor 1 | 7 | | | | | | SLE vs HV |
| 383 | 10134 | BCAP31 | B-cell receptor-associated protein 31 | 7 | | | | | | SLE vs HV |

TABLE 2-continued

List of all antigen reactivities

| SEQ ID No. | Gene GeneID | Gene Symbol | Gene Name | Group | Panel SLE | L. Nephr. | SLE Cluster | Statistical Test ENA-4 neg vs HV | L. Nephr. vs SLE | SLE vs control |
|---|---|---|---|---|---|---|---|---|---|---|
| 384 | 10522 | DEAF1 | deformed epidermal autoregulatory factor 1 (*Drosophila*) | 7 | | | | | | SLE vs HV |
| 385 | 10633 | RASL10A | RAS-like, family 10, member A | 7 | | | | | | SLE vs HV |
| 386 | 54795 | TRPM4 | transient receptor potential cation channel, subfamily M, member 4 | 7 | | | | | | SLE vs HV |
| 387 | 54913 | RPP25 | ribonuclease P/MRP 25 kDa subunit | 7 | | | | | | SLE vs HV |
| 388 | 54994 | C20orf11 | chromosome 20 open reading frame 11 | 7 | | | | | | SLE vs HV |
| 389 | 55727 | BTBD7 | BTB (POZ) domain containing 7 | 7 | | | | | | SLE vs HV |
| 390 | 79140 | CCDC28B | coiled-coil domain containing 28B | 7 | | | | | | SLE vs HV |
| 391 | 79613 | TMCO7 | transmembrane and coiled-coil domains 7 | 7 | | | | | | SLE vs HV |
| 392 | 5504 | PPP1R2 | protein phosphatase 1, regulatory (inhibitor) subunit 2 | 7 | | | | | | SLE vs HV |
| 393 | 8349 | HIST2H2BE | histone cluster 2, H2be | 7 | | | | | | SLE vs HV |
| 394 | 11168 | PSIP1 | PC4 and SFRS1 interacting protein 1 | 7 | | | | | | SLE vs HV |
| 395 | 149986 | LSM14B | LSM14B, SCD6 homolog B (*S. cerevisiae*) | 7 | | | | | | SLE vs HV |
| 396 | 655 | BMP7 | Bone morphogenetic protein 7 (osteogenic protein 1) | 7 | | | | | | SLE vs HV |
| 397 | 1676 | DFFA | DNA fragmentation factor, 45 kDa, alpha polypeptide | 7 | | | | | | SLE vs HV |
| 398 | 3071 | NCKAP1L | NCK-associated protein 1-like | 7 | | | | | | SLE vs HV |
| 399 | 3727 | JUND | jun D proto-oncogene | 7 | | | | | | SLE vs HV |
| 400 | 3960 | LGALS4 | lectin, galactoside-binding, soluble, 4 | 7 | | | | | | SLE vs HV |
| 401 | 4920 | ROR2 | Receptor tyrosine kinase-like orphan receptor 2 | 7 | | | | | | SLE vs HV |
| 402 | 7424 | VEGFC | vascular endothelial growth factor C | 7 | | | | | | SLE vs HV |
| 403 | 8906 | AP1G2 | adaptor-related protein complex 1, gamma 2 subunit | 7 | | | | | | SLE vs HV |
| 404 | 10297 | APC2 | adenomatosis polyposis coli 2 | 7 | | | | | | SLE vs HV |
| 405 | 10841 | FTCD | Formiminotransferase cyclodeaminase | 7 | | | | | | SLE vs HV |
| 406 | 11066 | SNRNP35 | small nuclear ribonucleoprotein 35 kDa (U11/U12) | 7 | | | | | | SLE vs HV |
| 407 | 11345 | GABARAPL2 | GABA(A) receptor-associated protein-like 2 | 7 | | | | | | SLE vs HV |
| 408 | 25854 | FAM149A | family with sequence similarity 149, member A | 7 | | | | | | SLE vs HV |
| 409 | 26065 | LSM14A | LSM14A, SCD6 homolog A (*S. cerevisiae*) | 7 | | | | | | SLE vs HV |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 410 | 28998 | MRPL13 | mitochondrial ribosomal protein L13 | 7 | | | | | | SLE vs HV |
| 411 | 51520 | LARS | leucyl-tRNA synthetase | 7 | | | | | | SLE vs HV |
| 412 | 55747 | FAM21B | family with sequence similarity 21, member B | 7 | | | | | | SLE vs HV |
| 413 | 64841 | GNPNAT1 | glucosamine-phosphate N-acetyltransferase 1 | 7 | | | | | | SLE vs HV |
| 414 | 83483 | PLVAP | Plasmalemma vesicle associated protein | 7 | | | | | | SLE vs HV |
| 415 | 84968 | PNMA6A | paraneoplastic antigen like 6A | 7 | | | | | | SLE vs HV |
| 416 | 118430 | MUCL1 | Mucin-like 1 | 7 | | | | | | SLE vs HV |
| 417 | 122830 | NAT12 | N-acetyltransferase 12 | 7 | | | | | | SLE vs HV |
| 418 | 221092 | HNRNPUL2 | heterogeneous nuclear ribonucleoprotein U-like 2 | 7 | | | | | | SLE vs HV |
| 419 | 388962 | BOLA3 | bolA homolog 3 (*E. coli*) | 7 | | | | | | SLE vs HV |
| 420 | 729230 | FLJ78302 | Similar to C-C chemokine receptor type 2 (C-C CKR-2) (CC-CKR-2) (CCR-2) (CCR2) (Monocyte chemoattractant protein 1 receptor) (MCP-1-R) (CD192 antigen) | 7 | | | | | | SLE vs HV |
| 421 | 729447 | GAGE2A | G antigen 2A | 7 | | | | | | SLE vs HV |
| 422 | 1152 | CKB | No Gene Name; creatine kinase, brain | 7 | | | | | | SLE vs HV |
| 423 | 972 | CD74 | CD74 molecule, major histocompatibility complex, class II invariant chain | 7 | | | | | | SLE vs HV |
| 424 | 1397 | CRIP2 | cysteine-rich protein 2 | 7 | | | | | | SLE vs HV |
| 425 | 2040 | STOM | stomatin | 7 | | | | | | SLE vs HV |
| 426 | 2316 | FLNA | filamin A, alpha | 7 | | | | | | SLE vs HV |
| 427 | 4000 | LMNA | lamin A/C | 7 | | | | | | SLE vs HV |
| 428 | 4582 | MUC1 | mucin 1, cell surface associated | 7 | | | | | | SLE vs HV |
| 429 | 5230 | PGK1 | Phosphoglycerate kinase 1 | 7 | | | | | | SLE vs HV |
| 430 | 5340 | PLG | plasminogen | 7 | | | | | | SLE vs HV |
| 431 | 6525 | SMTN | smoothelin | 7 | | | | | | SLE vs HV |
| 432 | 8936 | WASF1 | WAS protein family, member 1 | 7 | | | | | | SLE vs HV |
| 433 | 23647 | ARFIP2 | ADP-ribosylation factor interacting protein 2 | 7 | | | | | | SLE vs HV |
| 434 | 6712 | SPTBN2 | spectrin, beta, non-erythrocytic 2 | 7 | | | | | | SLE vs HV |
| 435 | 6729 | SRP54 | signal recognition particle 54 kDa | 7 | | | | | | SLE vs HV |

TABLE 2-continued

List of all antigen reactivities

| SEQ ID No. | GeneID | Gene Symbol | Gene Name | Group | Panel SLE | L. Nephr. | SLE Cluster | Statistical Test ENA-4 neg vs HV | L. Nephr. vs SLE | SLE vs control |
|---|---|---|---|---|---|---|---|---|---|---|
| 436 | 9987 | HNRPDL | heterogeneous nuclear ribonucleoprotein D-like | 7 | | | | | | SLE vs HV |
| 437 | 337 | APOA4 | Apolipoprotein A-IV | 7 | | | | | | SLE vs HV |
| 438 | 950 | SCARB2 | scavenger receptor class B, member 2 | 7 | | | | | | SLE vs HV |
| 439 | 3183 | HNRNPC | heterogeneous nuclear ribonucleoprotein C (C1/C2) | 7 | | | | | | SLE vs HV |
| 440 | 3185 | HNRPF | Heterogeneous nuclear ribonucleoprotein F | 7 | | | | | | SLE vs HV |
| 441 | 3313 | HSPA9 | heat shock 70 kDa protein 9 (mortalin) | 7 | | | | | | SLE vs HV |
| 442 | 3467 | IFNW1 | Interferon, omega 1 | 7 | | | | | | SLE vs HV |
| 443 | 3799 | KIF5B | kinesin family member 5B | 7 | | | | | | SLE vs HV |
| 444 | 7918 | BAT4 | HLA-B associated transcript 4 | 7 | | | | | | SLE vs HV |
| 445 | 8337 | HIST2H2AA3 | histone cluster 2, H2aa3 | 7 | | | | | | SLE vs HV |
| 446 | 10195 | ALG3 | asparagine-linked glycosylation 3, alpha-1,3-mannosyltransferase homolog (*S. cerevisiae*) | 7 | | | | | | SLE vs HV |
| 447 | 23299 | BICD2 | bicaudal D homolog 2 (*Drosophila*) | 7 | | | | | | SLE vs HV |
| 448 | 80184 | CEP290 | centrosomal protein 290 kDa | 7 | | | | | | SLE vs HV |
| 449 | 90861 | HN1L | hematological and neurological expressed 1-like | 7 | | | | | | SLE vs HV |
| 450 | 349136 | WDR86 | WD repeat domain 86 | 7 | | | | | | SLE vs HV |
| | no Gene ID | dsDNA | dsDNA | 7 | | | | | | SLE vs HV |
| 451 | 60 | ACTB | actin, beta | 8 | | | | | | SLE vs HV |
| 452 | 498 | ATP5A1 | ATP synthase, H+ transporting, mitochondrial F1 complex, alpha subunit 1, cardiac muscle | 8 | | | | | | SLE vs HV |
| 453 | 506 | ATP5B | ATP synthase, H+ transporting, mitochondrial F1 complex, beta polypeptide | 8 | | | | | | SLE vs HV |
| 454 | 563 | AZGP1 | alpha-2-glycoprotein 1, zinc-binding | 8 | | | | | | SLE vs HV |
| 455 | 602 | BCL3 | B-cell CLL/lymphoma 3 | 8 | | | | | | SLE vs HV |
| 456 | 1729 | DIAPH1 | diaphanous-related formin 1 | 8 | | | | | | SLE vs HV |
| 457 | 1937 | EEF1G | eukaryotic translation elongation factor 1 gamma | 8 | | | | | | SLE vs HV |
| 458 | 1973 | EIF4A1 | eukaryotic translation initiation factor 4A1 | 8 | | | | | | SLE vs HV |

TABLE 2-continued

List of all antigen reactivities

| SEQ ID No. | Gene GeneID | Gene Symbol | Gene Name | Group | Panel SLE | Panel L. Nephr. | SLE Cluster | Statistical Test ENA-4 neg vs HV | L. Nephr. vs SLE | SLE vs control |
|---|---|---|---|---|---|---|---|---|---|---|
| 459 | 2280 | FKBP1A | FK506 binding protein 1A, 12 kDa | 8 | | | | | | SLE vs HV |
| 460 | 2495 | FTH1 | ferritin, heavy polypeptide 1 | 8 | | | | | | SLE vs HV |
| 461 | 2597 | GAPDH | glyceraldehyde-3-phosphate dehydrogenase | 8 | | | | | | SLE vs HV |
| 462 | 2819 | GPD1 | glycerol-3-phosphate dehydrogenase 1 (soluble) | 8 | | | | | | SLE vs HV |
| 463 | 3295 | HSD17B4 | hydroxysteroid (17-beta) dehydrogenase 4 | 8 | | | | | | SLE vs HV |
| 464 | 3305 | HSPA1L | heat shock 70 kDa protein 1-like | 8 | | | | | | SLE vs HV |
| 465 | 3312 | HSPA8 | heat shock 70 kDa protein 8 | 8 | | | | | | SLE vs HV |
| 466 | 4174 | MCM5 | minichromosome maintenance complex component 5 | 8 | | | | | | SLE vs HV |
| 467 | 4215 | MAP3K3 | mitogen-activated protein kinase kinase kinase 3 | 8 | | | | | | SLE vs HV |
| 468 | 4591 | TRIM37 | tripartite motif containing 37 | 8 | | | | | | SLE vs HV |
| 469 | 4691 | NCL | nucleolin | 8 | | | | | | SLE vs HV |
| 470 | 4898 | NRD1 | nardilysin (N-arginine dibasic convertase) | 8 | | | | | | SLE vs HV |
| 471 | 4904 | YBX1 | Y box binding protein 1 | 8 | | | | | | SLE vs HV |
| 472 | 5037 | PEBP1 | phosphatidylethanolamine binding protein 1 | 8 | | | | | | SLE vs HV |
| 473 | 5315 | PKM2 | pyruvate kinase, muscle | 8 | | | | | | SLE vs HV |
| 474 | 5481 | PPID | peptidylprolyl isomerase D | 8 | | | | | | SLE vs HV |
| 475 | 5684 | PSMA3 | proteasome (prosome, macropain) subunit, alpha type, 3 | 8 | | | | | | SLE vs HV |
| 476 | 6128 | RPL6 | ribosomal protein L6 | 8 | | | | | | SLE vs HV |
| 477 | 6129 | RPL7 | ribosomal protein L7 | 8 | | | | | | SLE vs HV |
| 478 | 6130 | RPL7A | ribosomal protein L7a | 8 | | | | | | SLE vs HV |
| 479 | 6132 | RPL8 | ribosomal protein L8 | 8 | | | | | | SLE vs HV |
| 480 | 6187 | RPS2 | ribosomal protein S2 | 8 | | | | | | SLE vs HV |
| 481 | 6189 | RPS3A | ribosomal protein S3A | 8 | | | | | | SLE vs HV |
| 482 | 6249 | CLIP1 | CAP-GLY domain containing linker protein 1 | 8 | | | | | | SLE vs HV |
| 483 | 6793 | STK10 | serine/threonine kinase 10 | 8 | | | | | | SLE vs HV |
| 484 | 6880 | TAF9 | TAF9 RNA polymerase II, TATA box binding protein (TBP)-associated factor, 32 kDa | 8 | | | | | | SLE vs HV |
| 485 | 7001 | PRDX2 | peroxiredoxin 2 | 8 | | | | | | SLE vs HV |
| 486 | 7552 | ZNF711 | zinc finger protein 711 | 8 | | | | | | SLE vs HV |

TABLE 2-continued

List of all antigen reactivities

| SEQ ID No. | Gene GeneID | Gene Symbol | Gene Name | Panel Group | SLE | L. Nephr. | SLE Cluster | ENA-4 neg vs HV | L. Nephr. vs SLE | SLE vs control |
|---|---|---|---|---|---|---|---|---|---|---|
| 487 | 8260 | ARD1A | N(alpha)-acetyltransferase 10, NatA catalytic subunit | 8 | | | | | | SLE vs HV |
| 488 | 8317 | CDC7 | cell division cycle 7 | 8 | | | | | | SLE vs HV |
| 489 | 8667 | EIF3H | eukaryotic translation initiation factor 3, subunit H | 8 | | | | | | SLE vs HV |
| 490 | 9223 | MAGI1 | membrane associated guanylate kinase, WW and PDZ domain containing 1 | 8 | | | | | | SLE vs HV |
| 491 | 9230 | RAB11B | RAB11B, member RAS oncogene family | 8 | | | | | | SLE vs HV |
| 492 | 9425 | CDYL | chromodomain protein, Y-like | 8 | | | | | | SLE vs HV |
| 493 | 9694 | EMC2 | ER membrane protein complex subunit 2 | 8 | | | | | | SLE vs HV |
| 494 | 10075 | HUWE1 | HECT, UBA and WWE domain containing 1, E3 ubiquitin protein ligase | 8 | | | | | | SLE vs HV |
| 495 | 10109 | ARPC2 | actin related protein 2/3 complex, subunit 2, 34 kDa | 8 | | | | | | SLE vs HV |
| 496 | 10180 | RBM6 | RNA binding motif protein 6 | 8 | | | | | | SLE vs HV |
| 497 | 10273 | STUB1 | STIP1 homology and U-box containing protein 1, E3 ubiquitin protein ligase | 8 | | | | | | SLE vs HV |
| 498 | 10432 | RBM14 | RNA binding motif protein 14 | 8 | | | | | | SLE vs HV |
| 499 | 10539 | GLRX3 | glutaredoxin 3 | 8 | | | | | | SLE vs HV |
| 500 | 10806 | SDCCAG8 | serologically defined colon cancer antigen 8 | 8 | | | | | | SLE vs HV |
| 501 | 11108 | PRDM4 | PR domain containing 4 | 8 | | | | | | SLE vs HV |
| 502 | 23002 | DAAM1 | dishevelled associated activator of morphogenesis 1 | 8 | | | | | | SLE vs HV |
| 503 | 23351 | KHNYN | KH and NYN domain containing | 8 | | | | | | SLE vs HV |
| 504 | 23589 | CARHSP1 | calcium regulated heat stable protein 1, 24 kDa | 8 | | | | | | SLE vs HV |
| 505 | 26986 | PABPC1 | poly(A) binding protein, cytoplasmic 1 | 8 | | | | | | SLE vs HV |
| 506 | 27072 | VPS41 | vacuolar protein sorting 41 homolog (S. cerevisiae) | 8 | | | | | | SLE vs HV |
| 507 | 30836 | DNTTIP2 | deoxynucleotidyltransferase, terminal, interacting protein 2 | 8 | | | | | | SLE vs HV |
| 508 | 51028 | VPS36 | vacuolar protein sorting 36 homolog (S. cerevisiae) | 8 | | | | | | SLE vs HV |

TABLE 2-continued

List of all antigen reactivities

| SEQ ID No. | GeneID | Gene Symbol | Gene Name | Group | Panel SLE | Panel L. Nephr. | SLE Cluster | ENA-4 neg vs HV | L. Nephr. vs SLE | SLE vs control |
|---|---|---|---|---|---|---|---|---|---|---|
| 509 | 51082 | POLR1D | polymerase (RNA) I polypeptide D, 16 kDa | 8 | | | | | | SLE vs HV |
| 510 | 51138 | COPS4 | COP9 signalosome subunit 4 | 8 | | | | | | SLE vs HV |
| 511 | 51466 | EVL | Enah/Vasp-like | 8 | | | | | | SLE vs HV |
| 512 | 54869 | EPS8L1 | EPS8-like 1 | 8 | | | | | | SLE vs HV |
| 513 | 54903 | MKS1 | Meckel syndrome, type 1 | 8 | | | | | | SLE vs HV |
| 514 | 57017 | COQ9 | coenzyme Q9 | 8 | | | | | | SLE vs HV |
| 515 | 57026 | PDXP | pyridoxal (pyridoxine, vitamin B6) phosphatase | 8 | | | | | | SLE vs HV |
| 516 | 57221 | ARFGEF3 | ARFGEF family member 3 | 8 | | | | | | SLE vs HV |
| 517 | 64753 | CCDC136 | coiled-coil domain containing 136 | 8 | | | | | | SLE vs HV |
| 518 | 80208 | SPG11 | spastic paraplegia 11 (autosomal recessive) | 8 | | | | | | SLE vs HV |
| 519 | 83858 | ATAD3B | ATPase family, AAA domain containing 3B | 8 | | | | | | SLE vs HV |
| 520 | 84893 | FBXO18 | F-box protein, helicase, 18 | 8 | | | | | | SLE vs HV |
| 521 | 129563 | DIS3L2 | DIS3 like 3'-5' exoribonuclease 2 | 8 | | | | | | SLE vs HV |
| 522 | 144097 | C11orf84 | chromosome 11 open reading frame 84 | 8 | | | | | | SLE vs HV |
| 523 | 256364 | EML3 | echinorm microtubule associated protein like 3 | 8 | | | | | | SLE vs HV |
| 524 | 347733 | TUBB2B | tubulin, beta 2B class IIb | 8 | | | | | | SLE vs HV |
| 525 | 3303 | HSPA1A | heat shock 70 kDa protein 1A | 8 | | | | | | SLE vs HV |
| 526 | 5163 | PDK1 | pyruvate dehydrogenase kinase, isozyme 1 | 8 | | | | | | SLE vs HV |
| 527 | 1001 | CDH3 | cadherin 3, type 1, P-cadherin (placental) | 8 | | | | | | SLE vs HV |

Example 9

Identification of Autoantibody Reactivities in ENA-4-Negative SLE Patients

In order to identify new SLE-specific autoantigens, the autoantibody profiles of new SLE-specific autoantigens were the autoantibody profiles of the group of SLE patients seropositive for the autoantigens Sm-protein, U1-RNP, Rho52/SS-A and Ro60/SS-B, with which the seronegative was compared. The result of the statistical test is summarised in Table 2.

Group 4 comprises additional antigens suitable for the identification of ENA-4-negative SLE patients.

FIG. 5 shows the volcano plot of the autoantibody reactivities of ENA-4-positives compared to ENA-4-negative SLE patients.

Example 10

Calculation of Antigen Panels for Improved Diagnosis of SLE

Due to the high clinical and serological heterogeneity of the SLE disease, it is not possible to diagnose this disease using just one biomarker. It is therefore necessary to combine (where possible) uncorrelated biomarker panels to form what are known as biomarker panels.

Group 1 of the antigens in Table 2 comprises the most important 24 antigens used for the calculation of biomarker panels for the diagnosis of SLE.

Table 4 shows different combinations of antigens which were used for the calculation of the biomarker panels (ENA-4, ENA-4+anti-rib, PI, PII, PIII, PVI, PV).

FIG. 6 shows the sensitivity and specificity and also the area under the curve (AUC) for the known 4 antigens compared with antigen panels that were calculated using a combination of the antigens from Table 2. Due to the inclusion of the 3 ribosomal antigens anti-rib) RPLP0, RPLP1 and RPLP2, the sensitivity could be increased already by 10% compared with the known 4 ENA antigens from 0.63 to 0.72. However, only a freely selected combination of known and new antigens could increase the sensitivity by 20% compared with the ENA-4 test to 0.8.

Antigens which have an adjusted p-value for the non-parametric mean value comparison between groups of <0.05, alongside a fold change of >1.5 and additionally an AUC resulting from the ROC analysis of >0.75 were selected on the basis of the univariate results for the generation of panels. In addition, the ENA-4 antigens were selected. For this pool of selected candidates, an L1-penalised logistic regression model was established within the scope of a nested cross validation. Antigens which were not taken into consideration within the scope of the model formation were removed from the further consideration. Within the remaining pools, panel contents were defined, for example in accordance with established markers and new markers.

Group 4 in Table 2 contains further statistically significant antigens which can be used for the identification of ENA-4-negative patients and for the definition of biomarker panels.

Group 6 in Table 2 contains further statistically significant antigens which can be used for the diagnosis and differential diagnosis of SLE compared with healthy controls and other autoimmune diseases.

TABLE 4

Composition of the diagnostic SLE Panel

| Gene Symbol | Gene Name | Antigen | ENA-4 | ENA-4 + anti-rib | PI | PII | PIII | PVI | PV |
|---|---|---|---|---|---|---|---|---|---|
| SNRPN SEQ ID NO. 14 | small nuclear ribonucleoprotein polypeptide N | Sm protein D | X | X | | X | | X | |
| TRIM21 SEQ ID NO. 19 | tripartite motif-containing 21 | SSA/R0 | X | X | X | X | | X | |
| TROVE2 SEQ ID NO. 20 | TROVE domain family, member 2 | SSA/Ro60 | X | X | X | X | | X | |
| SSB SEQ ID NO. 17 | Sjogren syndrome antigen B (autoantigen La) | SSB/La | X | X | X | X | | X | |
| SNRNP70 SEQ ID NO. 12 | small nuclear ribonucleoprotein 70 kDa (U1) | U1-RNP | X | X | X | X | | X | |
| SNRPB SEQ ID NO. 13 | small nuclear ribonucleoprotein polypeptides B and B1 | Sm protein B/B' | X | X | X | X | | X | |
| RPLP0 SEQ ID NO. 8 | ribosomal protein, large, P0 | anti-rib | | X | X | | X | X | |
| RPLP2 SEQ ID NO. 10 | ribosomal protein, large, P2 | anti-rib | | X | | | X | X | |
| RPLP1 SEQ ID NO. 9 | ribosomal protein, large, P1 | anti-rib | | X | | | X | X | |
| XRCC5 SEQ ID NO. 22 | X-ray repair complementing defective repair in Chinese hamster cells 5 (double-strand-break rejoining) | Ku80 | | | | | | | X |
| VIM SEQ ID NO. 21 | vimentin | | | | | | X | | X |
| SPTB SEQ ID NO. 16 | spectrin, beta, erythrocytic | | | | | | X | | X |
| DBT SEQ ID NO. 1 | dihydrolipoamide branched chain transacylase E2 | | | | X | X | X | X | X |
| EZR SEQ ID NO. 3 | ezrin | | | | X | X | X | X | X |
| HNRNPA2B1 SEQ ID NO. 6 | heterogeneous nuclear ribonucleoprotein A2/B1 | | | | | | X | | X |

TABLE 4-continued

Composition of the diagnostic SLE Panel

| Gene Symbol | Gene Name | Antigen | ENA-4 | ENA-4 + anti-rib | PI | PII | PIII | PVI | PV |
|---|---|---|---|---|---|---|---|---|---|
| TMPO SEQ ID NO. 18 | thymopoietin | | | | X | | X | X | X |
| MVP SEQ ID NO. 7 | major vault protein | | | | X | X | X | | X |
| ZNF574 SEQ ID NO. 24 | zinc finger protein 574 | | | | X | X | | | X |
| HIST1H2BD SEQ ID NO. 4 | histone cluster 1, H2bd | anti-Histone | | | | X | | | X |
| SH3KBP1 SEQ ID NO. 11 | SH3-domain kinase binding protein 1 | | | | | | | | X |
| ZNF217 SEQ ID NO. 23 | zinc finger protein 217 | | | | | | | X | X |
| SP100 SEQ ID NO. 15 | SP100 nuclear antigen | | | | X | X | X | X | X |
| HNRNPA1 SEQ ID NO. 5 | heterogeneous nuclear ribonucleoprotein A1 | | | | X | X | X | X | X |
| DLAT SEQ ID NO. 2 | dihydrolipoamide S-acetyltransferase | PDC-E2, M2 antigen | | | X | | X | X | X |

TABLE 5

AUC, sensitivity and specificity of the SLE panels

| | AUC | CI (AUC) | Sens. | CI (Sens.) | Spec. | CI (Spec) |
|---|---|---|---|---|---|---|
| a) SLE versus healthy controls | | | | | | |
| SLE vs PSS | | | | | | |
| Panel PI | 0.99 | [0.94, 0.98] | 0.83 | [0.77, 0.9] | 0.98 | [0.96, 1.0] |
| Panel PII | 0.90 | [0.84, 0.95] | 0.63 | [0.53, 0.73] | 0.94 | [0.91, 0.98] |
| Panel PIII | 0.91 | [0.87, 0.95] | 0.61 | [0.5, 0.72] | 0.95 | [0.92, 0.98] |
| Panel PIV | 0.90 | [0.86, 0.94] | 0.57 | [0.44, 0.71] | 0.95 | [0.91, 0.99] |
| Panel PV | 0.91 | [0.87, 0.96] | 0.64 | [0.52, 0.76] | 0.95 | [0.91, 0.99] |
| ENA-4 | 0.89 | [0.84, 0.94] | 0.63 | [0.49, 0.77] | 0.96 | [0.94, 0.98] |
| ENA-4 + anti-rib | 0.93 | [0.88, 0.98] | 0.72 | [0.6, 0.84] | 0.97 | [0.95, 0.99] |
| b) SLE versus SSc (PSS) | | | | | | |
| Panel PI | 0.9 | [0.85, 0.95] | 0.78 | [0.73, 0.83] | 0.83 | [0.71, 0.94] |
| Panel PII | 0.83 | [0.78, 0.88] | 0.72 | [0.61, 0.83] | 0.76 | [0.68, 0.85] |
| Panel PIII | 0.81 | [0.74, 0.88] | 0.68 | [0.56, 0.79] | 0.75 | [0.6, 0.89] |
| panel PIV | 0.83 | [0.78, 0.88] | 0.69 | [0.58, 0.81] | 0.77 | [0.67, 0.87] |
| Panel PV | 0.84 | [0.79, 0.9] | 0.71 | [0.62, 0.8] | 0.76 | [0.65, 0.87] |
| ENA-4 | 0.75 | [0.66, 0.85] | 0.6 | [0.5, 0.7] | 0.8 | [0.71, 0.88] |
| ENA-4 + anti-rib | 0.82 | [0.74, 0.9] | 0.63 | [0.51, 0.75] | 0.83 | [0.74, 0.93] |
| c) SLE versus all AID (early RA, SSc, SPA) | | | | | | |
| SLE vs Pool (EA, PSS, SPA) | | | | | | |
| Panel PI | 0.94 | [0.91, 0.96] | 0.6 | [0.51, 0.69] | 0.98 | [0.98, 0.99] |
| Panel PII | 0.83 | [0.78, 0.89] | 0.26 | [0.16, 0.35] | 0.98 | [0.97, 0.99] |
| Panel PIII | 0.83 | [0.74, 0.92] | 0.27 | [0.16, 0.37] | 0.99 | [0.98, 1] |
| Panel PIV | 0.83 | [0.79, 0.87] | 0.19 | [0.1, 0.28] | 0.98 | [0.97, 0.99] |

TABLE 5-continued

AUC, sensitivity and specificity of the SLE panels

|  | AUC | CI (AUC) | Sens. | CI (Sens.) | Spec. | CI (Spec) |
|---|---|---|---|---|---|---|
| Panel PV | 0.85 | [0.78, 0.91] | 0.34 | [0.22, 0.46] | 0.99 | [0.98, 0.99] |
| ENA-4 | 0.84 | [0.79, 0.9] | 0.35 | [0.22, 0.47] | 0.99 | [0.98, 0.99] |
| ENA-4 + anti-rib | 0.91 | [0.88, 0.93] | 0.49 | [0.41, 0.58] | 0.98 | [0.97, 0.99] |

Example 11

Identification of Lupus Nephritis Patients

The autoantibody profiles of SLE patients with lupus nephritis were compared with those of SLE patients without lupus nephritis. Following univariate statistical evaluation, a threshold value of p<0.05 and a 1.5 times modified reactivity compared with the control group were applied. 85 antigens met these criteria and are detailed in Table 2.

FIG. 7 shows the volcano plot of the sera compared with selected lupus nephritis antigens.

Group 2 in Table 2 contains 30 additional and important antigens which can be used for the generation of lupus nephritis biomarker panels.

An L1-penalised logistic regression model with five-fold cross validation and twenty times repetition was computed for the selection of the best candidates. The antigens selected most frequently in this model computation with a frequency of more than 50% constituted the best candidates for the diagnosis of lupus nephritis.

FIG. 8 shows the frequency distribution of the lupus nephritis antigens.

Group 5 comprises further statistically significant antigens suitable for the diagnosis of lupus nephritis.

Example 12

Identification of SLE Subforms and Subgroups

The large clinical heterogeneity of SLE constitutes a big problem both for diagnosis and active substance development.

The identification of specific antibody signatures in SLE patient subgroups thus constitutes a key step for the improved definition of patient groups in clinical studies. By way of example, as presented under Example 9, specific antibodies for lupus nephritis could be used to recruit this subgroup for drug studies.

A large number of new active substances and therapeutic antibodies are currently undergoing clinical development: inter alia, therapeutic antibodies against cell-surface receptors of immune cells, such as anti-CD20, anti-CD22, or against pro-inflammatory cytokines, such as anti-IL6, are being developed. It is therefore now possible, due to the identification of serologically-defined subgroups of SLE, to link this to a target-specific response to a drug.

It was first examined whether, on the basis of the typical ENA antigens and ribosomal antigens, different autoantibody signatures can already be identified in SLE patients and thus patient subgroups.

FIGS. 9a and b show a dendogram of the SLE antigens after calculation of Spearman's rank correlation coefficient FIG. 9a shows a dendogram for the antigens Sm, SS-B, Ro-52/SS-A, Ro60-SS-B and three ribosomal proteins.

3 antigen clusters can be already be defined on the basis of these 7 antigens.

For an improved definition of SLE subgroups, however, a larger number of antigens are necessary. 50 antigens from Table 2 were therefore selected, and the correlation thereof in SLE patients was examined by calculation of Spearman's rank correlation coefficient.

Group 3 contains 37 of the most important antigens necessary for the characterisation of SLE subgroups. Further antigens have already been defined in group 1 and group 2.

The presentation of the antigens as a dendogram shows groups of antigens of which the reactivities in SLE patients are correlated with one another.

As illustrated in FIG. 9b, at least 6 groups of correlated antigens can be identified as a result.

Interestingly, one of the clusters includes the antigens MVP, MIER2, CCS, DCAF6, which were identified in the table as biomarkers for lupus nephritis.

Due to the calculation of a PPLS-DA-based regression model, it is possible to visualise how well the selected antigens contribute to the discrimination of the SLE patients from healthy controls.

Figure 10A:
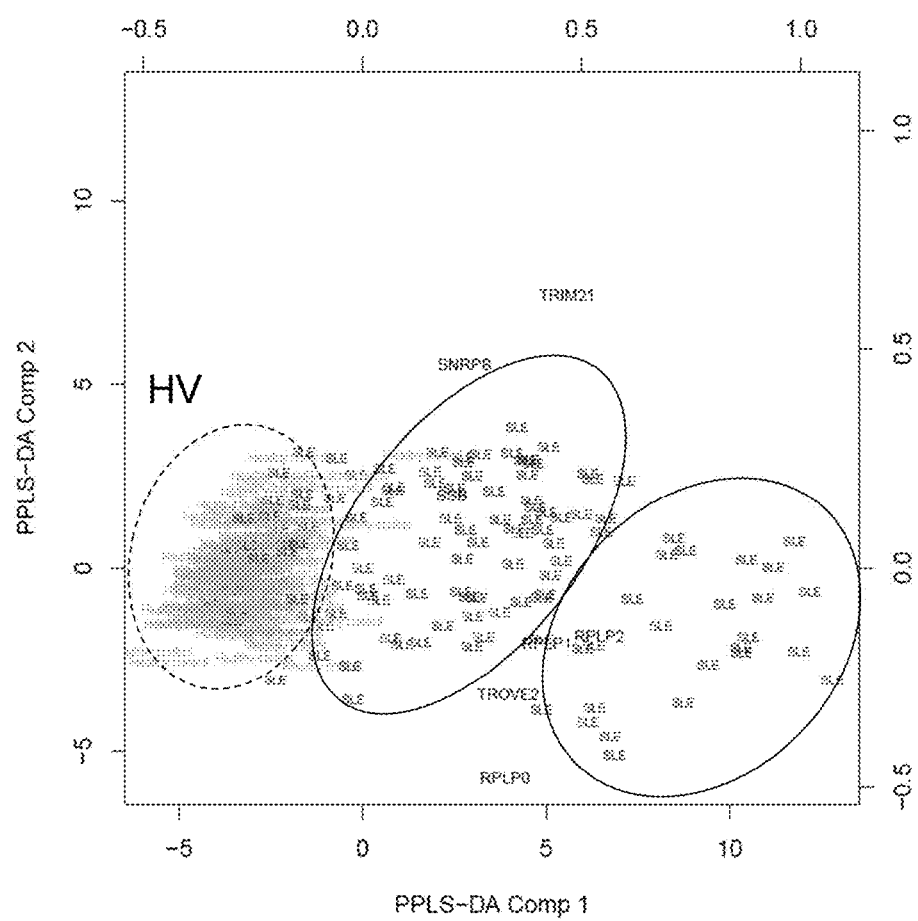

FIGS. 10a and b show the PPLS-DA biplot of the SLE patients and healthy controls with use of the SLE antigens.

FIG. 10a shows a PPLS-DA biplot for the selected ENA antigens and ribosomal proteins and measured values thereof in the SLE patients. FIG. 10a shows that the separation of healthy and SLE is not complete and that some SLE patients coincide with the group of healthy samples. However, there is already a division of the SLE patients into 2 clusters with just few antigens.

Figure 10B:
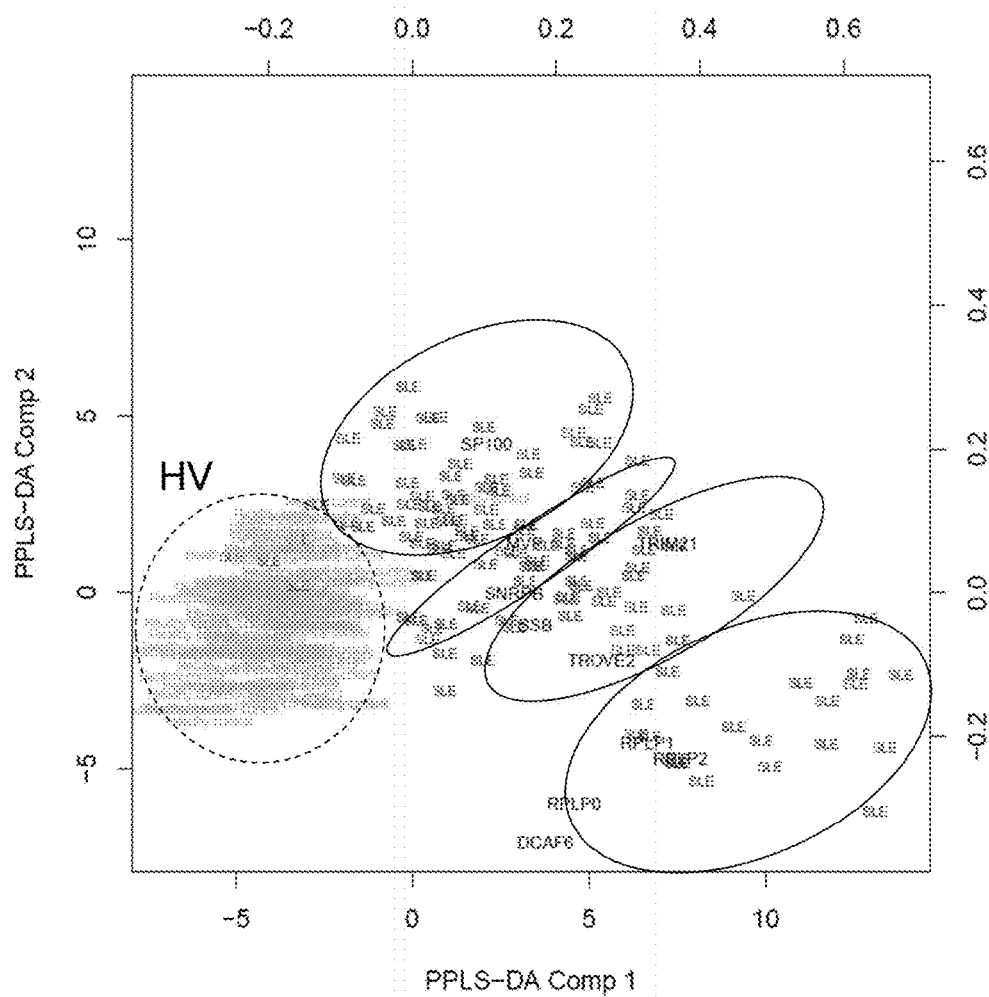

FIG. 10b shows a PPLS-DA biplot for 50 antigens which are contained in Table 2. The selection of further antigens results in a practically perfect separation of the SLE patients and healthy samples.

A further subdivision of the SLE patients into possible subgroups is provided by 50 antigens. These subgroups can be defined by specific antigens, some of which have been highlighted by way of example.

Example 13

Validation of SLE Antigens in an Independent Test Cohort II

For validation of the SLE-associated autoantigens specified in Table 2, the autoantibody reactivity in serum samples of a further independent cohort of 101 SLE patients, 105 healthy controls and 89 samples of the SLE cohort from Example 6 was measured. For this purpose the 529 human proteins specified in Table 2 (SEQ ID No. 1057 to 1584), and double-stranded DNA (dsDNA) thereof, were coupled to Luminex beads, and the antigen-coupled beads were measured in a multiplex assay with the patient samples. The binding of autoantibodies was measured by means of a PE-conjugated autoantibody in a Luminex instrument.

Following univariate statistical evaluation, a threshold value of p<0.05 (Wilcoxon rank-sum test) compared with the control group was applied.

A list of the significance values (p-values) for autoantibodies against 50 antigens in the SLE cohort II is shown in Table 6. Of the 50 antigens, 43 antigens in cohort I and cohort II achieved a p-value <0.05.

The frequency (in %) of autoantibodies against 50 antigens in the three SLE cohorts is shown in Table 7.

Figure 11:
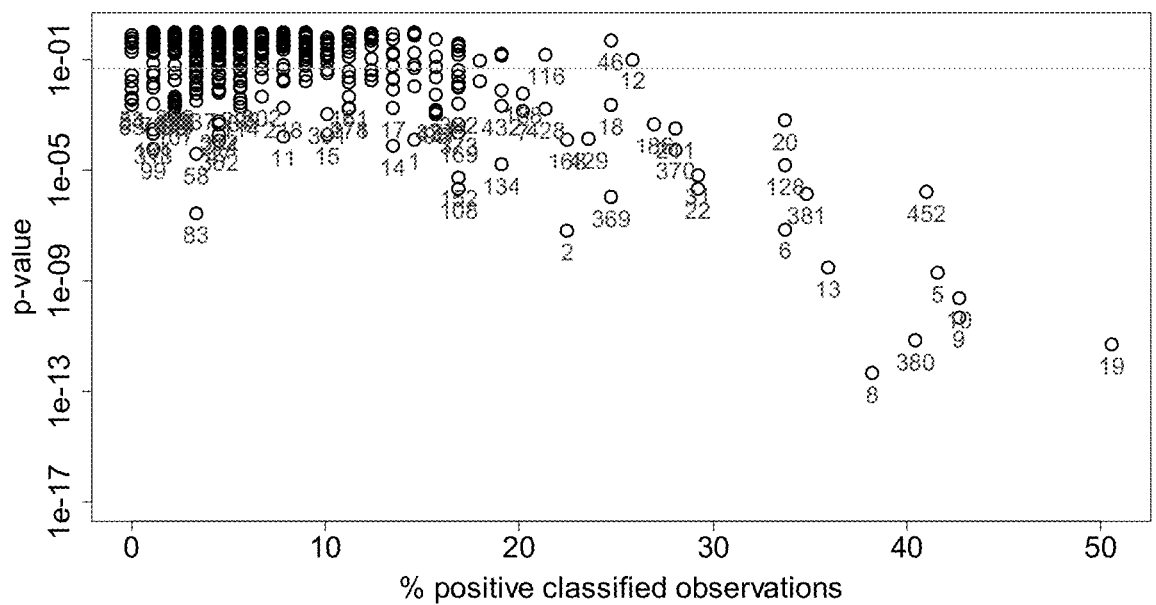
Figure 11:
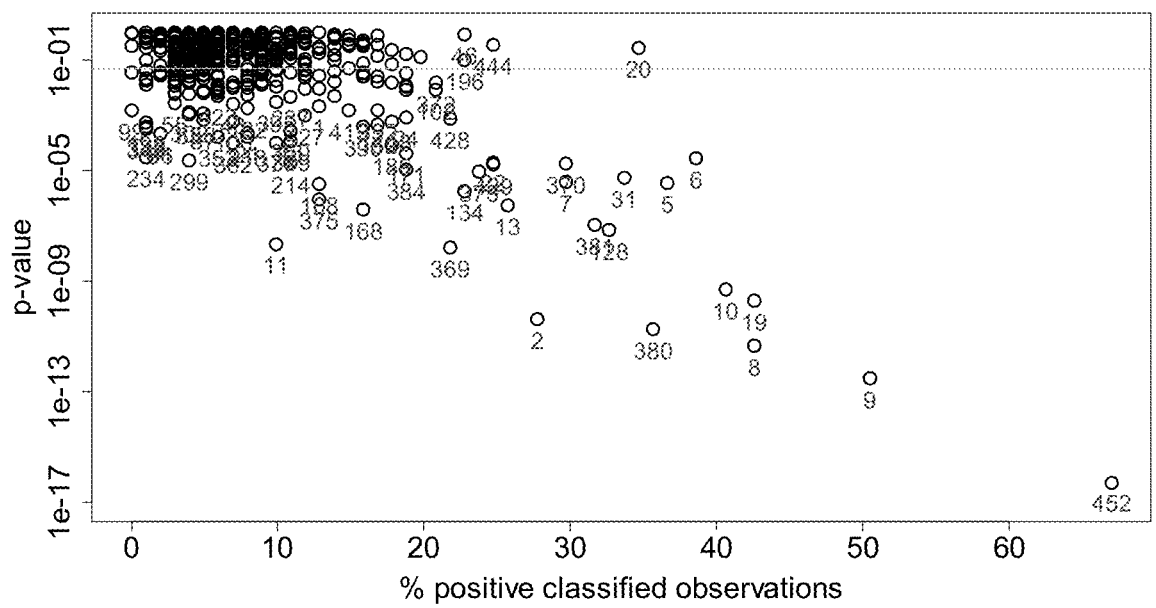
Figure 11:
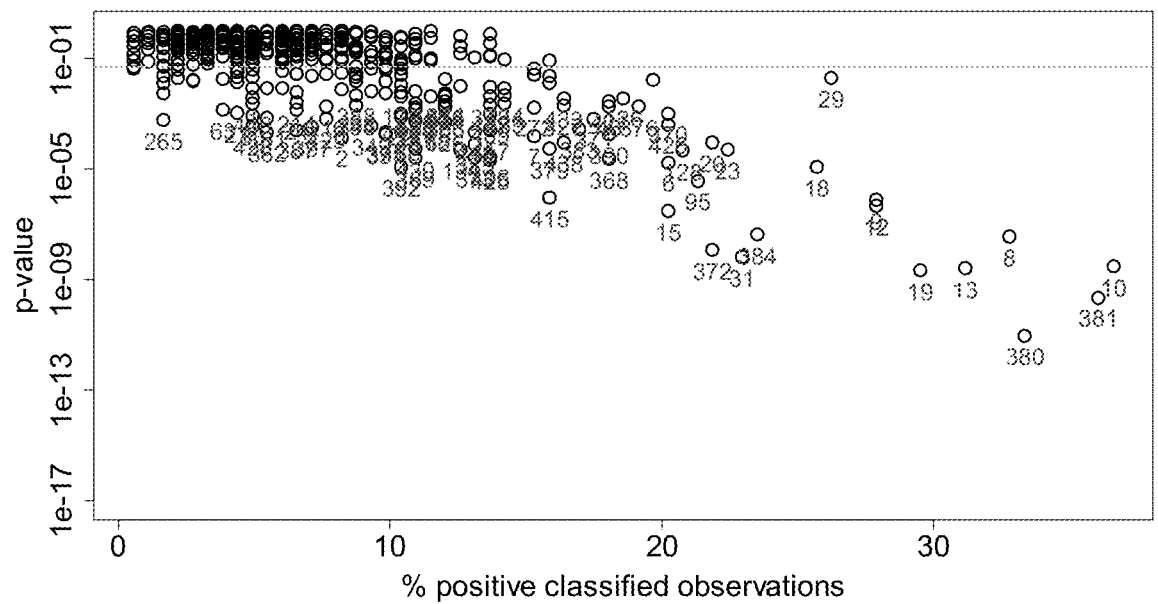

FIG. 11: shows the calculated p-value of the antigens from Table 2 and also the frequency of SLE patients who were classified as autoantibody-positive for this antigen.

Example 14

Validation of SLE Autoantigens in a Third Independent Test Cohort III

For validation of the SLE-associated autoantigens specified in Table 2, the autoantibody reactivity in serum samples of an independent cohort of 183 SLE patients and 109 healthy controls was measured. For this purpose, 6,912 human proteins were coupled to Luminex beads and the protein-coupled beads were measured in a multiplex assay with the patient samples. The binding of autoantibodies was measured by means of a PE-conjugated autoantibody in a Luminex instrument.

After univariate statistical evaluation, a threshold value of $p<0.05$ and a Cohen's d effect size of greater than 0.3 compared to the control group was provided.

A list of the significance values is shown in Table 6. The table contains selected markers which are part of the panels ENA+anti-rib, panel I, panel VI, panel VII and panel VIII.

The table contains further markers which achieved a p-value of <0.05 in all three cohorts.

TABLE 6 significance values (p-values) of 50 antigens in 3 SLE cohorts

| Seq. Nr | GeneID | Gene Symbol | SLE cohort I | SLE cohort II | SLE cohort III | Panel |
|---|---|---|---|---|---|---|
| 1 | 1629 | DBT | 1.28E−04 | 2.16E−03 | 3.82E−03 | Panel I; II; III; IV; V; VII |
| 2 | 1737 | DLAT | 6.33E−08 | 4.12E−11 | 1.31E−04 | Panel I; III; IV; VI; VII |
| 3 | 7430 | EZR | 1.44E−03 | 2.68E−01 | 9.79E−02 | panel I; II; III; IV |
| 4 | 3017 | HIST1H2BD | 9.43E−01 | 4.08E−01 | 4.00E−02 | Panel II, V |
| 5 | 3178 | HNRNPA1 | 1.99E−09 | 3.60E−06 | 2.81E−04 | Panel I; II, III; IV; V; VI; VII |
| 6 | 3181 | HNRNPA2B1 | 7.31E−08 | 2.81E−05 | 1.70E−05 | Panel III; V; VI; VII |
| 7 | 9961 | MVP | 1.40E−03 | 3.90E−06 | 1.56E−04 | Panel I; II; III; V; VI; VII |
| 8 | 6175 | RPLP0 | 4.59E−13 | 4.75E−12 | 3.51E−08 | ENA-4 + anti-rib, Panel I; III; VI; VII |
| 9 | 6176 | RPLP1 | 4.61E−11 | 3.05E−13 | 7.50E−07 | ENA-4 + anti-rib; Panel III; IV; VII |
| 10 | 6181 | RPLP2 | 2.38E−10 | 5.18E−10 | 2.94E−09 | ENA-4 + anti-rib; Panel I; VI; VII |
| 11 | 30011 | SH3KBP1 | 1.68E−04 | 2.22E−08 | 2.64E−02 | Panel V |
| 12 | 6625 | SNRNP70 | 4.87E−02 | 9.02E−02 | 1.22E−08 | ENA-4 + anti-rib; Panel I; II; IV |
| 13 | 6628 | SNRPB | 2.95E−09 | 5.57E−07 | 2.49E−09 | ENA-4 + anti-rib; Panel I; II; IV; VI; VII |
| 14 | 6638 | SNRPN | 7.44E−05 | 2.61E−02 | 3.64E−02 | ENA-4 + anti-rib, Panel II; Panel IV |
| 15 | 6672 | SP100 | 1.98E−04 | 2.47E−04 | 3.04E−07 | Panel I; II; III; IV; V; VII |
| 16 | 6710 | SPTB | 7.76E−06 | 5.13E−01 | 8.37E−01 | Panel III; V |
| 17 | 6741 | SSB | 1.75E−03 | 3.20E−02 | 7.82E−02 | ENA-4 + anti-rib; Panel I; II; IV |
| 18 | 7112 | TMPO | 2.20E−03 | 3.15E−02 | 1.15E−05 | Panel I; II; III; IV; VI |
| 19 | 6737 | TRIM21 | 5.07E−12 | 1.96E−10 | 6.35E−10 | Panel I; II; iV; VI; VII |
| 20 | 6738 | TROVE2 | 6.11E−04 | 2.59E−01 | 9.27E−05 | ENA-4 + anti-rib; Panel I; II; IV |
| 21 | 7431 | VIM | 2.37E−01 | 2.25E−04 | 1.06E−03 | Panel III; V |
| 22 | 7520 | XRCC5 | 2.06E−06 | 2.01E−05 | 7.83E−04 | Panel V; VI; VII |
| 23 | 7764 | ZNF217 | 3.28E−01 | 1.55E−01 | 5.04E−05 | Panel III; V |
| 24 | 64763 | ZNF574 | 1.02E−02 | 8.36E−05 | 1.33E−03 | Panel I; II; V; VII |
| 31 | 9973 | CCS | 6.65E−06 | 5.28E−06 | 6.62E−09 | Panel VII |
| 95 | 6629 | SNRPB2 | 1.06E−03 | 8.68E−03 | 3.66E−06 | Panel VIII |
| 128 | 10970 | CKAP4 | 1.52E−05 | 7.26E−08 | 4.60E−05 | Panel VIII |
| 134 | 1743 | DLST | 1.63E−05 | 1.78E−06 | 4.95E−05 | Panel VIII |
| 168 | 4841 | NONO | 1.27E−04 | 3.76E−07 | 5.17E−04 | Panel VI; VII |
| 169 | 29982 | NRBF2 | 2.22E−04 | 2.44E−02 | 7.44E−03 | Panel VIII |
| 171 | 4926 | NUMA1 | 1.62E−03 | 4.28E−05 | 4.31E−03 | Panel VIII |
| 213 | 7791 | ZYX | 4.54E−04 | 1.77E−05 | 2.57E−03 | Panel VII |
| 367 | 4670 | HNRNPM | 7.61E−03 | 8.98E−03 | 2.34E−05 | Panel VII |
| 368 | 10540 | DCTN2 | 1.11E−06 | 1.69E−08 | 2.49E−05 | Panel VII |

TABLE 6-continued significance values (p-values) of 50 antigens in 3 SLE cohorts

| Seq. Nr | GeneID | Gene Symbol | SLE cohort I | SLE cohort II | SLE cohort III | Panel |
|---|---|---|---|---|---|---|
| 369 | 10938 | EHD1 | 5.60E−05 | 1.73E−05 | 1.01E−03 | Panel VII |
| 371 | 684 | BST2 | 2.51E−02 | 1.44E−02 | 1.13E−08 | Panel VIII |
| 372 | 1058 | CENPA | 4.45E−04 | 8.70E−06 | 2.51E−05 | Panel VIII |
| 374 | 3092 | HIP1 | 4.42E−02 | 8.73E−07 | 2.03E−04 | Panel VIII |
| 375 | 3336 | HSPE1 | 2.15E−02 | 1.42E−02 | 1.73E−03 | Panel VIII |
| 376 | 5455 | POU3F3 | 1.31E−03 | 1.02E−04 | 6.18E−03 | Panel VIII |
| 379 | 6626 | SNRPA | 7.16E−12 | 1.85E−11 | 2.60E−16 | Panel VIII |
| 380 | 6631 | SNRPC | 1.42E−06 | 1.06E−07 | 3.73E−15 | Panel VIII |
| 381 | 6757 | SSX2 | 2.40E−03 | 1.78E−02 | 2.09E−04 | Panel VIII |
| 383 | 10134 | BCAP31 | 4.10E−02 | 1.04E−05 | 4.34E−08 | Panel VIII |
| 389 | 55727 | BTBD7 | 3.33E−02 | 3.68E−04 | 1.79E−04 | Panel VIII |
| 427 | 4000 | LMNA | 1.59E−03 | 7.49E−04 | 3.41E−04 | Panel VIII |
| 428 | 4582 | MUC1 | 1.35E−04 | 1.66E−05 | 6.29E−04 | Panel VIII |
| 430 | 5340 | PLG | 1.22E−03 | 1.64E−02 | 5.61E−03 | Panel VIII |
| 431 | 6525 | SMTN | 2.05E−03 | 1.53E−02 | 9.78E−03 | Panel VIII |
| 451 | dsDNA | dsDNA | 1.65E−06 | 5.35E−17 | NA | dsDNA |

TABLE 7

List of the frequency of SLE patients positively tested for autoantibodies in 3 independent cohorts. The frequency in % of individuals positively tested for autoantibodies from Table 6 was calculated by means of the 95% quantile of healthy controls.

Proportion of SLE patients positively tested for autoantibodies (%) based on the 95% quantile of the control group

| Seq. Nr. | GeneID | Gene Symbol | SLE cohort I | SLE cohort II | SLE cohort III | Panel |
|---|---|---|---|---|---|---|
| 1 | 1629 | DBT | 1.28E−04 | 2.16E−03 | 3.82E−03 | Panel I; II; III; IV; V; VII |
| 2 | 1737 | DLAT | 6.33E−08 | 4.12E−11 | 1.31E−04 | Panel I; III; IV; VI; VII |
| 3 | 7430 | EZR | 1.44E−03 | 2.68E−01 | 9.79E−02 | panel I; II; III; IV |
| 4 | 3017 | HIST1H2BD | 9.43E−01 | 4.08E−01 | 4.00E−02 | Panel II, V |
| 5 | 3178 | HNRNPA1 | 1.99E−09 | 3.60E−06 | 2.81E−04 | Panel I; II, III; IV; VI; VII |
| 6 | 3181 | HNRNPA2B1 | 7.31E−08 | 2.81E−05 | 1.70E−05 | Panel III; V; VI; VII |
| 7 | 9961 | MVP | 1.40E−03 | 3.90E−06 | 1.56E−04 | Panel I; II; III; V; VI; VII |
| 8 | 6175 | RPLP0 | 4.59E−13 | 4.75E−12 | 3.51E−08 | ENA-4 + anti-rib, Panel I; III; VI; VII |
| 9 | 6176 | RPLP1 | 4.61E−11 | 3.05E−13 | 7.50E−07 | ENA-4 + anti-rib; Panel III; IV; VII |
| 10 | 6181 | RPLP2 | 2.38E−10 | 5.18E−10 | 2.94E−09 | ENA-4 + anti-rib; Panel I; VI; VII |
| 11 | 30011 | SH3KBP1 | 1.68E−04 | 2.22E−08 | 2.64E−02 | Panel V |
| 12 | 6625 | SNRNP70 | 4.87E−02 | 9.02E−02 | 1.22E−08 | ENA-4 + anti-rib; Panel I; II; IV |
| 13 | 6628 | SNRPB | 2.95E−09 | 5.57E−07 | 2.49E−09 | ENA-4 + anti-rib; Panel I; II; IV; VI; VII |
| 14 | 6638 | SNRPN | 7.44E−05 | 2.61E−02 | 3.64E−02 | ENA-4 + anti-rib, Panel II; Panel IV |
| 15 | 6672 | SP100 | 1.98E−04 | 2.47E−04 | 3.04E−07 | Panel I; II; III; IV; V; VII |

TABLE 7-continued

List of the frequency of SLE patients positively
tested for autoantibodies in 3 independent cohorts.
The frequency in % of individuals positively tested for
autoantibodies from Table 6 was calculated by means of the 95%
quantile of healthy controls.

| Seq. Nr. | GeneID | Gene Symbol | SLE cohort I | SLE cohort II | SLE cohort III | Panel |
|---|---|---|---|---|---|---|
| | | | | | Proportion of SLE patients positively tested for autoantibodies (%) based on the 95% quantile of the control group | |
| 16 | 6710 | SPTB | 7.76E−06 | 5.13E−01 | 8.37E−01 | Panel III; V |
| 17 | 6741 | SSB | 1.75E−03 | 3.20E−02 | 7.82E−02 | ENA-4 + anti-rib; Panel I; II; IV |
| 18 | 7112 | TMPO | 2.20E−03 | 3.15E−02 | 1.15E−05 | Panel I; II; III; IV; VI |
| 19 | 6737 | TRIM21 | 5.07E−12 | 1.96E−10 | 6.35E−10 | Panel I; II; iV; VI; VII |
| 20 | 6738 | TROVE2 | 6.11E−04 | 2.59E−01 | 9.27E−05 | ENA-4 + anti-rib; Panel I; II; IV |
| 21 | 7431 | VIM | 2.37E−01 | 2.25E−04 | 1.06E−03 | Panel III; V |
| 22 | 7520 | XRCC5 | 2.06E−06 | 2.01E−05 | 7.83E−04 | Panel V; VI; VII |
| 23 | 7764 | ZNF217 | 3.28E−01 | 1.55E−01 | 5.04E−05 | Panel III; V |
| 24 | 64763 | ZNF574 | 1.02E−02 | 8.36E−04 | 1.33E−03 | Panel I; II; V; VII |
| 31 | 9973 | CCS | 6.65E−06 | 5.28E−06 | 6.62E−09 | Panel VII |
| 95 | 6629 | SNRPB2 | 1.06E−03 | 8.68E−03 | 3.66E−06 | Panel VIII |
| 128 | 10970 | CKAP4 | 1.52E−05 | 7.26E−08 | 4.60E−05 | Panel VIII |
| 134 | 1743 | DLST | 1.63E−05 | 1.78E−06 | 4.95E−05 | Panel VII |
| 168 | 4841 | NONO | 1.27E−04 | 3.76E−07 | 5.17E−04 | Panel VI; VII |
| 169 | 29982 | NRBF2 | 2.22E−04 | 2.44E−02 | 7.44E−03 | Panel VIII |
| 171 | 4926 | NUMA1 | 1.62E−03 | 4.28E−05 | 4.31E−03 | Panel VIII |
| 213 | 7791 | ZYX | 4.54E−04 | 1.77E−05 | 2.57E−03 | Panel VII |
| 367 | 4670 | HNRNPM | 7.61E−03 | 8.98E−03 | 2.34E−05 | Panel VII |
| 368 | 10540 | DCTN2 | 1.11E−06 | 1.69E−08 | 2.49E−05 | Panel VII |
| 369 | 10938 | EHD1 | 5.60E−05 | 1.73E−05 | 1.01E−03 | Panel VII |
| 371 | 684 | BST2 | 2.51E−02 | 1.44E−02 | 1.13E−08 | Panel VIII |
| 372 | 1058 | CENPA | 4.45E−04 | 8.70E−06 | 2.51E−05 | Panel VIII |
| 374 | 3092 | HIP1 | 4.42E−02 | 8.73E−07 | 2.03E−04 | Panel VIII |
| 375 | 3336 | HSPE1 | 2.15E−02 | 1.42E−02 | 1.73E−03 | Panel VIII |
| 376 | 5455 | POU3F3 | 1.31E−03 | 1.02E−04 | 6.18E−03 | Panel VIII |
| 379 | 6626 | SNRPA | 7.16E−12 | 1.85E−11 | 2.60E−16 | Panel VIII |
| 380 | 6631 | SNRPC | 1.42E−06 | 1.06E−07 | 3.73E−15 | Panel VIII |
| 381 | 6757 | SSX2 | 2.40E−03 | 1.78E−02 | 2.09E−04 | Panel VIII |
| 383 | 10134 | BCAP31 | 4.10E−02 | 1.04E−05 | 4.34E−08 | Panel VIII |
| 389 | 55727 | BTBD7 | 3.33E−02 | 3.68E−04 | 1.79E−04 | Panel VIII |
| 427 | 4000 | LMNA | 1.59E−03 | 7.49E−04 | 3.41E−04 | Panel VIII |
| 428 | 4582 | MUC1 | 1.35E−04 | 1.66E−05 | 6.29E−04 | Panel VIII |
| 430 | 5340 | PLG | 1.22E−03 | 1.64E−02 | 5.61E−03 | Panel VIII |
| 431 | 6525 | SMTN | 2.05E−03 | 1.53E−02 | 9.78E−03 | Panel VIII |
| dsDNA | dsDNA | | 1.65E−06 | 5.35E−17 | NA | dsDNA |

Example

Calculation of Biomarker Panels

As shown in Table 7, only at most approximately 60% of the SLE patients had antibodies for a specific autoantigen. In order to therefore increase the sensitivity of the diagnostic autoantibodies, such as anti-dsDNA, SSA-Ro (TRIM21/TROVE2) and U1-RNP (SNRNP70, SNRPNA, SNRNPC), new methods with which autoantibodies can be combined to form what are known as biomarker panels were tested.

For this pool of selected candidates, a logistic regression was carried out for panels PI to PVII. An L1-penalised logistic regression model was established within the scope of a nested cross validation for panels PVIII to PXI. Antigens which were not considered within the scope of the model formation were removed from the further consideration. The content of panels was defined within the remaining pool, for example in accordance with established markers and new markers.

The antigens specified in Table 2 were used for the calculation of biomarker panels for the diagnosis of SLE.

Table 4 shows different combinations of antigens which were used for the calculation of the biomarker panels (ENA-4, ENA-4+anti-rib, PI, PII, PIII, PVI, PV).

Table 8 shows further different combinations of antigens which were used for the calculation of panels and which were selected on account of their significance and reactivity in three SLE cohorts.

TABLE 8

Combinations of antigens from Table 2:

| Seq. ID Nr | GeneID | Gene Symbol | Panel ENA-4 | +anti-rib | Panel PI | Panel PII | Panel PIII | Panel PIV | Panel PV | Panel VI | Panel VII | Panel VIII | Panel IX | Panel X* | Panel XI* |
|---|---|---|---|---|---|---|---|---|---|---|---|---|---|---|---|
| 1 | 1629 | DBT | | | x | x | x | x | x | | x | x | x | x | x |
| 2 | 1737 | DLAT | | | x | | x | x | x | x | x | x | x | x | x |
| 5 | 3178 | HNRNPA1 | | | x | x | x | x | | x | x | x | x | x | x |
| 6 | 3181 | HNRNPA2B1 | | | | | x | x | x | x | x | x | x | x | x |
| 7 | 9961 | MVP | | | x | x | x | | x | | | x | x | x | x |
| 8 | 6175 | RPLP0 | | x | x | | x | x | | x | | x | x | x | x |
| 9 | 6176 | RPLP1 | | x | | | x | x | | | x | x | x | x | x |
| 10 | 6181 | RPLP2 | | x | x | | x | x | | x | | x | x | x | x |
| 13 | 6628 | SNRPB | x | x | x | x | | x | | x | | x | x | x | x |
| 15 | 6672 | SP100 | | | x | x | x | x | x | | x | x | x | x | x |
| 19 | 6737 | TRIM21 | x | x | x | x | | x | | x | | x | x | x | x |
| 22 | 7520 | XRCC5 | | | | | | | | x | x | x | x | x | x |
| 24 | 64763 | ZNF574 | | | x | x | | | x | | x | x | x | x | x |
| 134 | 1743 | DLST | | | | | | | | x | x | x | x | x | x |
| 168 | 4841 | NONO | | | | | | | | | x | x | x | x | x |
| 213 | 7791 | ZYX | | | | | | | | | x | x | x | x | x |
| 367 | 4670 | HNRNPM | | | | | | | | | x | x | x | x | x |
| 368 | 10540 | DCTN2 | | | | | | | | | x | x | x | x | x |
| 369 | 10938 | EHD1 | | | | | | | | | x | x | x | x | x |
| 4 | 3017 | HIST1H2BD | | | | x | | x | | | | x | x | x | x |
| 12 | 6625 | SNRNP70 | x | x | x | x | | x | | | | x | x | x | x |
| 17 | 6741 | SSB | x | x | x | x | | x | | | | x | x | x | x |
| 18 | 7112 | TMPO | | | x | x | x | x | x | x | | x | x | x | x |
| 20 | 6738 | TROVE2 | x | x | x | x | | x | | | | x | x | x | x |
| 21 | 7431 | VIM | | | | | x | | x | | | x | x | x | x |
| 23 | 7764 | ZNF217 | | | | | x | | x | | | x | x | x | x |
| 29 | 9478 | CABP1 | | | | | | | | | | x | x | x | x |
| 31 | 9973 | CCS | | | | | | | | | | x | x | x | x |
| 46 | 4869 | NPM1 | | | | | | | | | | x | x | x | x |
| 95 | 6629 | SNRPB2 | | | | | | | | | | x | x | x | x |
| 128 | 10970 | CKAP4 | | | | | | | | | | x | x | x | x |
| 136 | 51143 | DYNC1LI1 | | | | | | | | | | x | x | x | x |
| 143 | 23360 | FNBP4 | | | | | | | | | | x | x | x | x |
| 163 | 4688 | NCF2 | | | | | | | | | | x | x | x | x |
| 169 | 29982 | NRBF2 | | | | | | | | | | x | x | x | x |
| 171 | 4926 | NUMA1 | | | | | | | | | | x | x | x | x |
| 188 | 644096 | SDHAF1 | | | | | | | | | | x | x | x | x |
| 348 | 56674 | TMEM9B | | | | | | | | | | x | x | x | x |
| 370 | 38 | ACAT1 | | | | | | | | | | x | x | x | x |
| 371 | 684 | BST2 | | | | | | | | | | x | x | x | x |
| 372 | 1058 | CENPA | | | | | | | | | | x | x | x | x |
| 373 | 1665 | DHX15 | | | | | | | | | | x | x | x | x |
| 374 | 3092 | HIP1 | | | | | | | | | | x | x | x | x |
| 375 | 3336 | HSPE1 | | | | | | | | | | x | x | x | x |
| 376 | 5455 | POU3F3 | | | | | | | | | | x | x | x | x |
| 377 | 5918 | RARRES1 | | | | | | | | | | x | x | x | x |
| 378 | 6136 | RPL12 | | | | | | | | | | x | x | x | x |
| 379 | 6626 | SNRPA | | | | | | | | | | x | x | x | x |
| 380 | 6631 | SNRPC | | | | | | | | | | x | x | x | x |
| 381 | 6757 | SSX2 | | | | | | | | | | x | x | x | x |
| 382 | 9788 | MTSS1 | | | | | | | | | | x | x | x | x |
| 383 | 10134 | BCAP31 | | | | | | | | | | x | x | x | x |
| 384 | 10522 | DEAF1 | | | | | | | | | | x | x | x | x |
| 385 | 10633 | RASL10A | | | | | | | | | | x | x | x | x |
| 386 | 54795 | TRPM4 | | | | | | | | | | x | x | x | x |
| 387 | 54913 | RPP25 | | | | | | | | | | x | x | x | x |
| 388 | 54994 | C20orf11 | | | | | | | | | | x | x | x | x |
| 389 | 55727 | BTBD7 | | | | | | | | | | x | x | x | x |
| 390 | 79140 | CCDC28B | | | | | | | | | | x | x | x | x |
| 391 | 79613 | TMCO7 | | | | | | | | | | x | x | x | x |
| 423 | 972 | CD74 | | | | | | | | | | x | x | x | x |
| 424 | 1397 | CRIP2 | | | | | | | | | | x | x | x | x |
| 425 | 2040 | STOM | | | | | | | | | | x | x | x | x |
| 426 | 2316 | FLNA | | | | | | | | | | x | x | x | x |
| 427 | 4000 | LMNA | | | | | | | | | | x | x | x | x |
| 428 | 4582 | MUC1 | | | | | | | | | | x | x | x | x |
| 429 | 5230 | PGK1 | | | | | | | | | | x | x | x | x |
| 430 | 5340 | PLG | | | | | | | | | | x | x | x | x |
| 431 | 6525 | SMTN | | | | | | | | | | x | x | x | x |
| 432 | 8936 | WASF1 | | | | | | | | | | x | x | x | x |
| 433 | 23647 | ARFIP2 | | | | | | | | | | x | x | x | x |
| 3 | 7430 | EZR | | | x | x | x | x | x | | | | x | x | x |
| 11 | 30011 | SH3KBP1 | | | | | | | x | | | | x | x | x |
| 14 | 6638 | SNRPN | x | x | | x | | x | | | | | x | x | x |
| 16 | 6710 | SPTB | | | | x | | x | | | | | x | x | x |

TABLE 8-continued

Combinations of antigens from Table 2:

| Seq. ID Nr | GeneID | Gene Symbol | Panel ENA-4 | +anti-rib | Panel PI | Panel PII | Panel PIII | Panel PIV | Panel PV | Panel VI | Panel VII | Panel VIII | Panel IX | Panel X* | Panel XI* |
|---|---|---|---|---|---|---|---|---|---|---|---|---|---|---|---|
| 33 | 55802 | DCP1A | | | | | | | | | | | x | x | x |
| 41 | 54531 | MIER2 | | | | | | | | | | | x | x | x |
| 48 | 11040 | PIM2 | | | | | | | | | | | x | x | x |
| 74 | 10933 | MORF4L1 | | | | | | | | | | | x | x | x |
| 105 | 8615 | USO1 | | | | | | | | | | | x | x | x |
| 108 | 375690 | WASH5P | | | | | | | | | | | x | x | x |
| 114 | 55256 | ADI1 | | | | | | | | | | | x | x | x |
| 115 | 9255 | AIMP1 | | | | | | | | | | | x | x | x |
| 116 | 54522 | ANKRD16 | | | | | | | | | | | x | x | x |
| 132 | 8642 | DCHS1 | | | | | | | | | | | x | x | x |
| 140 | 100129583 | FAM47E | | | | | | | | | | | x | x | x |
| 145 | 64689 | GORASP1 | | | | | | | | | | | x | x | x |
| 152 | 23135 | KDM6B | | | | | | | | | | | x | x | x |
| 166 | 22861 | NLRP1 | | | | | | | | | | | x | x | x |
| 170 | 8439 | NSMAF | | | | | | | | | | | x | x | x |
| 174 | 5195 | PEX14 | | | | | | | | | | | x | x | x |
| 186 | 8578 | SCARF1 | | | | | | | | | | | x | x | x |
| 191 | 6421 | SFPQ | | | | | | | | | | | x | x | x |
| 197 | 54961 | SSH3 | | | | | | | | | | | x | x | x |
| 202 | 90326 | THAP3 | | | | | | | | | | | x | x | x |
| 255 | 55740 | ENAH | | | | | | | | | | | x | x | x |
| 263 | 150946 | FAM59B | | | | | | | | | | | x | x | x |
| 277 | 3304 | HSPA1B | | | | | | | | | | | x | x | x |
| 292 | 4137 | MAPT | | | | | | | | | | | x | x | x |
| 331 | 4736 | RPL10A | | | | | | | | | | | x | x | x |
| 343 | 23345 | SYNE1 | | | | | | | | | | | x | x | x |
| 350 | 10155 | TRIM28 | | | | | | | | | | | x | x | x |
| 358 | 65109 | UPF3B | | | | | | | | | | | x | x | x |
| 392 | 5504 | PPP1R2 | | | | | | | | | | | x | x | x |
| 393 | 8349 | HIST2H2BE | | | | | | | | | | | x | x | x |
| 394 | 11168 | PSIP1 | | | | | | | | | | | x | x | x |
| 395 | 149986 | LSM14B | | | | | | | | | | | x | x | x |
| 434 | 6712 | SPTBN2 | | | | | | | | | | | x | x | x |
| 435 | 6729 | SRP54 | | | | | | | | | | | x | x | x |
| 436 | 9987 | HNRPDL | | | | | | | | | | | x | x | x |

*The panels X and XI can be supplemented by 20 or more markers from the other available 1587 markers, in particular proteins.

Panel VI comprises 11 antigens which were measured in all three SLE cohorts with a p-value <0.05.

Panel VII comprises 19 antigens which were measured in the three SLE cohorts with a p-value <0.05.

Panel VIII comprises panel VII and a further 52 antigens which were found in cohort 3 and at least one of the other SLE cohorts with a p-value <0.05 for the comparison of SLE against healthy controls.

Panel IX comprises panel VII, panel VIII and a further 110 antigens which, in one or two SLE cohorts for the comparison of SLE against healthy controls, achieved a p-value of 0.05.

Panel X comprises panel VII, panel VIII, panel IX and a further 227 antigens which, as specified in Table 2, originate from different comparisons and achieved a p-value <0.05 in at least one SLE cohort.

Tables 9a, 9c and 9e show the area under the curve (AUC) confidence interval, sensitivity and specificity of different biomarker combinations in the three different SLE cohorts.

Tables 9b and 9d show the area under the curve (AUC), confidence interval, sensitivity and specificity of the different panels in the three SLE cohorts in combination with anti-dsDNA autoantibodies.

TABLE 9a

Area under the curve (AUC), sensitivity and specificity of the different panels in the SLE cohort I.

| Cohort I Panel | AUC | | | Sensitivity | | | Specificity | | |
|---|---|---|---|---|---|---|---|---|---|
| | mean | lower CI | upper CI | mean | lower CI | upper CI | mean | lower CI | upper CI |
| PI | 0.86 | 0.84 | 0.87 | 0.79 | 0.76 | 0.81 | 0.84 | 0.82 | 0.86 |
| PII | 0.88 | 0.87 | 0.90 | 0.81 | 0.79 | 0.84 | 0.82 | 0.80 | 0.85 |
| PIII | 0.84 | 0.83 | 0.86 | 0.74 | 0.71 | 0.76 | 0.80 | 0.77 | 0.83 |
| PIV | 0.85 | 0.84 | 0.87 | 0.80 | 0.77 | 0.82 | 0.83 | 0.81 | 0.85 |
| PV | 0.81 | 0.79 | 0.83 | 0.73 | 0.70 | 0.75 | 0.76 | 0.73 | 0.79 |
| PVI | 0.87 | 0.86 | 0.89 | 0.79 | 0.77 | 0.82 | 0.83 | 0.81 | 0.85 |
| Panel.ENA | 0.87 | 0.85 | 0.88 | 0.73 | 0.71 | 0.76 | 0.86 | 0.84 | 0.89 |
| Panel.ENA + antiRib | 0.87 | 0.85 | 0.88 | 0.78 | 0.75 | 0.80 | 0.83 | 0.81 | 0.85 |
| PVII | 0.79 | 0.77 | 0.81 | 0.75 | 0.72 | 0.78 | 0.77 | 0.74 | 0.79 |

TABLE 9a-continued

Area under the curve (AUC), sensitivity and specificity of the different panels in the SLE cohort I.

| Cohort I Panel | AUC mean | lower CI | upper CI | Sensitivity mean | lower CI | upper CI | Specificity mean | lower CI | upper CI |
|---|---|---|---|---|---|---|---|---|---|
| PVIII | 0.85 | 0.83 | 0.86 | 0.75 | 0.72 | 0.78 | 0.82 | 0.79 | 0.84 |
| PIX | 0.83 | 0.81 | 0.84 | 0.73 | 0.71 | 0.76 | 0.81 | 0.78 | 0.83 |
| PX | 0.83 | 0.81 | 0.84 | 0.73 | 0.70 | 0.76 | 0.78 | 0.76 | 0.81 |
| PXI | 0.83 | 0.81 | 0.84 | 0.74 | 0.71 | 0.76 | 0.79 | 0.76 | 0.81 |

TABLE 9b

Area under the curve (AUC), upper and lower confidence interval (CI), sensitivity and specificity of the biomarker panels in SLE cohort I in combination with anti-dsDNA autoantibodies.

| Cohort I Panel plus dsDNA | AUC mean | lower CI | upper CI | Sensitivity mean | lower CI | upper CI | Specificity mean | lower CI | upper CI |
|---|---|---|---|---|---|---|---|---|---|
| PI | 0.86 | 0.84 | 0.87 | 0.79 | 0.77 | 0.81 | 0.83 | 0.81 | 0.85 |
| PII | 0.87 | 0.85 | 0.88 | 0.80 | 0.77 | 0.82 | 0.81 | 0.79 | 0.83 |
| PIII | 0.83 | 0.81 | 0.85 | 0.74 | 0.71 | 0.77 | 0.78 | 0.76 | 0.81 |
| PIV | 0.86 | 0.84 | 0.87 | 0.79 | 0.76 | 0.82 | 0.83 | 0.81 | 0.85 |
| PV | 0.80 | 0.78 | 0.82 | 0.72 | 0.70 | 0.75 | 0.76 | 0.73 | 0.78 |
| PVI | 0.86 | 0.85 | 0.88 | 0.79 | 0.77 | 0.82 | 0.82 | 0.80 | 0.85 |
| Panel.ENA | 0.86 | 0.85 | 0.88 | 0.73 | 0.71 | 0.76 | 0.86 | 0.84 | 0.89 |
| Panel.ENA + antiRib | 0.86 | 0.85 | 0.88 | 0.76 | 0.74 | 0.78 | 0.83 | 0.80 | 0.85 |
| PVII | 0.79 | 0.77 | 0.81 | 0.74 | 0.71 | 0.77 | 0.76 | 0.73 | 0.78 |
| PVIII | 0.89 | 0.88 | 0.90 | 0.80 | 0.78 | 0.83 | 0.85 | 0.83 | 0.87 |
| PIX | 0.90 | 0.89 | 0.92 | 0.81 | 0.79 | 0.83 | 0.85 | 0.83 | 0.87 |
| PX | 0.84 | 0.82 | 0.86 | 0.73 | 0.70 | 0.75 | 0.81 | 0.79 | 0.84 |
| PXI | 0.89 | 0.88 | 0.90 | 0.81 | 0.78 | 0.83 | 0.84 | 0.82 | 0.86 |

TABLE 9c

Area under the curve (AUC), shows the sensitivity and specificity of the different panels in the SLE cohort II.

| Cohort II Panel | AUC mean | lower CI | upper CI | Sensitivity mean | lower CI | upper CI | Specificity mean | lower CI | upper CI |
|---|---|---|---|---|---|---|---|---|---|
| PI | 0.84 | 0.83 | 0.86 | 0.74 | 0.72 | 0.76 | 0.79 | 0.77 | 0.81 |
| PII | 0.78 | 0.77 | 0.80 | 0.68 | 0.65 | 0.70 | 0.72 | 0.70 | 0.75 |
| PIII | 0.83 | 0.81 | 0.84 | 0.73 | 0.70 | 0.75 | 0.78 | 0.76 | 0.81 |
| PIV | 0.86 | 0.84 | 0.87 | 0.76 | 0.74 | 0.78 | 0.81 | 0.79 | 0.84 |
| PV | 0.77 | 0.75 | 0.78 | 0.67 | 0.65 | 0.69 | 0.74 | 0.72 | 0.76 |
| PVI | 0.87 | 0.86 | 0.88 | 0.77 | 0.74 | 0.79 | 0.82 | 0.80 | 0.84 |
| Panel.ENA | 0.76 | 0.74 | 0.77 | 0.59 | 0.56 | 0.61 | 0.78 | 0.75 | 0.80 |
| Panel.ENA + antiRib | 0.84 | 0.83 | 0.86 | 0.73 | 0.71 | 0.76 | 0.83 | 0.82 | 0.85 |
| PVII | 0.84 | 0.82 | 0.86 | 0.76 | 0.74 | 0.78 | 0.80 | 0.77 | 0.82 |
| PVIII | 0.85 | 0.83 | 0.86 | 0.76 | 0.74 | 0.78 | 0.80 | 0.78 | 0.82 |
| PIX | 0.84 | 0.83 | 0.86 | 0.76 | 0.74 | 0.78 | 0.79 | 0.77 | 0.81 |
| PX | 0.83 | 0.81 | 0.85 | 0.76 | 0.73 | 0.78 | 0.78 | 0.76 | 0.80 |
| PXI | 0.82 | 0.81 | 0.84 | 0.74 | 0.71 | 0.76 | 0.79 | 0.76 | 0.81 |

TABLE 9d

Area under the curve (AUC), sensitivity and specificity of the different panels in SLE cohort II in combination with anti-dsDNA autoantibodies.

| Cohort II Panel plus dsDNA | AUC mean | lower CI | upper CI | Sensitivity mean | lower CI | upper CI | Specificity mean | lower CI | upper CI |
|---|---|---|---|---|---|---|---|---|---|
| PI | 0.84 | 0.82 | 0.85 | 0.73 | 0.71 | 0.76 | 0.78 | 0.76 | 0.81 |
| PII | 0.78 | 0.76 | 0.80 | 0.67 | 0.65 | 0.70 | 0.73 | 0.70 | 0.75 |
| PIII | 0.82 | 0.81 | 0.84 | 0.73 | 0.71 | 0.75 | 0.76 | 0.74 | 0.79 |
| PIV | 0.85 | 0.84 | 0.87 | 0.76 | 0.73 | 0.78 | 0.80 | 0.78 | 0.83 |
| PV | 0.77 | 0.75 | 0.78 | 0.67 | 0.65 | 0.69 | 0.71 | 0.69 | 0.74 |
| PVI | 0.87 | 0.85 | 0.88 | 0.77 | 0.75 | 0.79 | 0.82 | 0.80 | 0.84 |
| Panel.ENA | 0.77 | 0.76 | 0.79 | 0.60 | 0.58 | 0.63 | 0.77 | 0.75 | 0.80 |
| Panel.ENA + antiRib | 0.85 | 0.84 | 0.86 | 0.73 | 0.71 | 0.76 | 0.83 | 0.81 | 0.85 |
| PVII | 0.84 | 0.82 | 0.85 | 0.75 | 0.73 | 0.78 | 0.79 | 0.77 | 0.82 |
| PVIII | 0.85 | 0.83 | 0.86 | 0.72 | 0.70 | 0.75 | 0.83 | 0.80 | 0.85 |
| PIX | 0.78 | 0.77 | 0.80 | 0.64 | 0.62 | 0.67 | 0.78 | 0.75 | 0.80 |
| PX | 0.84 | 0.83 | 0.85 | 0.72 | 0.70 | 0.75 | 0.83 | 0.81 | 0.85 |
| PXI | 0.87 | 0.85 | 0.88 | 0.75 | 0.73 | 0.77 | 0.84 | 0.82 | 0.86 |

TABLE 9e

Area under the curve (AUC), sensitivity and specificity of the different panels in the SLE cohort III.

| Cohort III Panel | AUC mean | lower CI | upper CI | Sensitivity mean | lower CI | upper CI | Specificity mean | lower CI | upper CI |
|---|---|---|---|---|---|---|---|---|---|
| PI | 0.83 | 0.82 | 0.84 | 0.71 | 0.69 | 0.73 | 0.80 | 0.78 | 0.81 |
| PII | 0.82 | 0.81 | 0.84 | 0.71 | 0.69 | 0.72 | 0.80 | 0.79 | 0.81 |
| PIII | 0.79 | 0.78 | 0.80 | 0.65 | 0.63 | 0.67 | 0.76 | 0.74 | 0.78 |
| PIV | 0.82 | 0.81 | 0.83 | 0.71 | 0.69 | 0.73 | 0.79 | 0.78 | 0.81 |
| PV | 0.77 | 0.76 | 0.78 | 0.66 | 0.64 | 0.67 | 0.76 | 0.74 | 0.78 |
| PVI | 0.84 | 0.83 | 0.85 | 0.71 | 0.70 | 0.73 | 0.81 | 0.79 | 0.82 |
| Panel.ENA | 0.78 | 0.77 | 0.80 | 0.65 | 0.63 | 0.67 | 0.82 | 0.81 | 0.84 |
| Panel.ENA + antiRib | 0.79 | 0.78 | 0.80 | 0.67 | 0.66 | 0.69 | 0.83 | 0.82 | 0.85 |
| PVII | 0.83 | 0.82 | 0.84 | 0.72 | 0.71 | 0.74 | 0.79 | 0.77 | 0.81 |
| PVIII | 0.83 | 0.82 | 0.84 | 0.73 | 0.72 | 0.75 | 0.77 | 0.76 | 0.79 |
| PIX | 0.81 | 0.79 | 0.82 | 0.72 | 0.70 | 0.74 | 0.76 | 0.74 | 0.77 |
| PX | 0.79 | 0.78 | 0.81 | 0.73 | 0.71 | 0.75 | 0.76 | 0.74 | 0.78 |
| PXI | 0.78 | 0.77 | 0.80 | 0.70 | 0.69 | 0.72 | 0.75 | 0.73 | 0.77 |

FIG. 11: The figure shows the comparison of the calculated p-values and autoantibody frequencies (% positive classified observations) for the antigens from Table 2 in the three SLE cohorts. The antigens are illustrated as circles with the consecutive number. The horizontal line marks the threshold value of p<0.05 for the comparison of SLE compared with healthy controls.

LITERATURE

Li P H, Wong W H, Lee T L, Lau C S, Chan T M, Leung A M, Tong K L, Tse N K, Mok C C, Wong S N, Lee K W, Ho M H, Lee P P, Chong C Y, Wong R W, Mok M Y, Ying S K, Fung S K, Lai W M, Yang W, Lau Y L. Relationship between autoantibody clustering and clinical subsets in SLE: cluster and association analyses in Hong Kong Chinese. Rheumatology (Oxford). 2013 February; 52(2): 337-45. doi: 10.1093/rheumatology/kes261. Epub 2012 Oct. 4. PubMed PMID: 23038697.

Liu C C, Kao A H, Manzi S, Ahearn J M. Biomarkers in systemic lupus erythematosus: challenges and prospects for the future. Ther Adv Musculoskelet Dis. 2013 August; 5(4):210-33.

Ching K H, Burbelo P D, Tipton C, Wei C, Petri M, Sanz I, Iadarola M J. Two major autoantibody clusters in systemic lupus erythematosus. PLoS One. 2012; 7(2): e32001. doi: 10.1371/journal.pone.0032001. Epub 2012 Feb. 21. PubMed PMID: 22363785; PubMed Central PMCID: PMC3283706.

Stohl W. Future prospects in biologic therapy for systemic lupus erythematosus. Nat Rev Rheumatol. 2013 Sep. 10. doi: 10.1038/nrrheum.2013.136. [Epub ahead of print] PubMed PMID: 24018550.

Thanou A, Merrill J T. Treatment of systemic lupus erythematosus: new therapeutic avenues and blind alleys. Nat Rev Rheumatol. 2013 Oct. 8. doi:10.1038/nrrheum.2013.145. [Epub ahead of print] PubMed PMID: 24100460.

Sherer Y, Gorstein A, Fritzler M J, Shoenfeld Y. Autoantibody explosion in systemic lupus erythematosus: more than 100 different antibodies found in SLE patients. Semin Arthritis Rheum. 2004 October; 34(2):501-37. Review. PubMed PMID: 15505768.

SEQUENCE LISTING (1584 sequences)

SEQ ID NO: 1 - DNA, 1320 bp, Homo sapiens
ggtcaggttgttcagttcaaactgagcgatattggtgaaggtattcgtgaagttaccgtgaaagaatggtatgtgaaagaaggtgataccgtcagccagtttgatagcatttgtgaagttcagagcgataaagcaagcgttaccattaccagccgttatgatggtgttatcaaaaaactgtactacaacctggatgatattgcctatgttggtaaaccgctggttgatattgaaaccgaagcactgaaagatagcgaagaagatgttgttgaaacaccggcagttagccatgatgaacatacccatcaagaaatcaaaggtcgtaaaaccctggcaactccggcagttcgtcgtctggcaatggaaaataacattaaactgagtgaagttgtgggcagcggtaaagatggtcgtattctgaaagaagatatcctgaactacctggaaaaacagaccggtgcaattctgcctccgagcccgaaagttgaaattatgcctccgcctccgaaaccgaaagatatgaccgttccgattctggttagcaaaccgcctgtttttaccggcaaagataaaaccgaaccgattaaaggttttcagaaagccatggttaaaaccatgagcgcagccctgaaaattccgcattttggttattgtgatgaaatcgatctgaccgaactggtgaaactgcgtgaagaactgaaaccgattgcatttgcacgtggtattaaactgtcatttatgccgttttttctgaaagcagcaagcctgggtctgctgcagtttccgatcctgaatgcaagcgttgatgaaaattgtcagaacatcacctataaagccagccataacattggtattgcaatggataccgaacagggtctgattgttccgaatgttaaaaatgttcagatttgcagcatctttgatatcgccaccgaactgaatcgtctgcagaaactgggtagcgttagccagctgagcaccaccgatctgacaggtggcacctttaccctgagtaatattggtagcattggtggtacatttgccaaaccggttattatgccaccggaagttgcaattggtgccctgggtagcattaaagcaattccgcgttttaatcagaaaggcgaagtttataaagcccagatcatgaatgttagctggtcagcagatcatcgtgttattgatggtgccaccatgagccgttttagcaatctgtggaaaagctatctggaaaatccggcatttatgctgctggatctgaaaagatcttaagcggccgcctgggcctcatgggccttcctttcactgcccgctttccag

SEQ ID NO: 2 - DNA, 1944 bp, Homo sapiens
atgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaa

SEQ ID NO: 3 - DNA, 1313 bp, Homo sapiens
  misc_feature (835)..(835): n is a, c, g, or t
  misc_feature (837)..(837): n is a, c, g, or t
  misc_feature (859)..(859): n is a, c, g, or t
  misc_feature (882)..(882): n is a, c, g, or t
  misc_feature (913)..(913): n is a, c, g, or t
  misc_feature (925)..(925): n is a, c, g, or t
  misc_feature (930)..(930): n is a, c, g, or t
  misc_feature (947)..(947): n is a, c, g, or t
  misc_feature (958)..(958): n is a, c, g, or t
  misc_feature (988)..(988): n is a, c, g, or t
  misc_feature (994)..(994): n is a, c, g, or t
  misc_feature (1012)..(1012): n is a, c, g, or t
  misc_feature (1015)..(1015): n is a, c, g, or t
  misc_feature (1021)..(1021): n is a, c, g, or t
  misc_feature (1043)..(1043): n is a, c, g, or t
  misc_feature (1060)..(1060): n is a, c, g, or t
  misc_feature (1062)..(1062): n is a, c, g, or t
  misc_feature (1065)..(1065): n is a, c, g, or t
  misc_feature (1069)..(1069): n is a, c, g, or t
  misc_feature (1079)..(1079): n is a, c, g, or t
  misc_feature (1083)..(1083): n is a, c, g, or t
  misc_feature (1091)..(1091): n is a, c, g, or t
  misc_feature (1094)..(1094): n is a, c, g, or t
  misc_feature (1115)..(1115): n is a, c, g, or t
  misc_feature (1117)..(1117): n is a, c, g, or t
  misc_feature (1119)..(1120): n is a, c, g, or t
  misc_feature (1128)..(1128): n is a, c, g, or t
  misc_feature (1140)..(1142): n is a, c, g, or t
  misc_feature (1153)..(1153): n is a, c, g, or t
  misc_feature (1157)..(1158): n is a, c, g, or t
  misc_feature (1188)..(1188): n is a, c, g, or t
  misc_feature (1190)..(1190): n is a, c, g, or t
  misc_feature (1202)..(1202): n is a, c, g, or t
  misc_feature (1209)..(1210): n is a, c, g, or t
  misc_feature (1213)..(1213): n is a, c, g, or t
  misc_feature (1220)..(1220): n is a, c, g, or t
  misc_feature (1224)..(1224): n is a, c, g, or t
  misc_feature (1231)..(1232): n is a, c, g, or t
  misc_feature (1234)..(1234): n is a, c, g, or t
  misc_feature (1243)..(1243): n is a, c, g, or t
  misc_feature (1246)..(1246): n is a, c, g, or t
  misc_feature (1248)..(1248): n is a, c, g, or t
  misc_feature (1258)..(1258): n is a, c, g, or t
  misc_feature (1265)..(1266): n is a, c, g, or t
  misc_feature (1273)..(1273): n is a, c, g, or t
  misc_feature (1287)..(1287): n is a, c, g, or t
  misc_feature (1306)..(1306): n is a, c, g, or t
  misc_feature (1309)..(1309): n is a, c, g, or t
agagaaattactatgagaggatcgcatcaccatcaccatcacggatcctatttaggtgacactatagaatcgtcgacccacgcgtccgttggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccagnanagcttgcaggatgagggcgcanagcccacgggctacagcgcgganctgtctagtgagggcatccgggatgaccgcnatgaggaaaacncatcnctgaggcaaaaaaaacnagcgtgtgcancggcagctgctgaccctgaacaccgagctnttccangcccgaaatgaaaataanagnaccccnatgacttcctccccaacgaaancttgaggcagggccggnanaantacnaaaccctgcngcanatccgggnggnaaccccaaccacccctccacnantnnaggccctntaaacccggccnnnacaagggcaangggnncctaagggggccttcccccccccccccttntnttttggcccaanctaagannccncaatccnttcnttaaaanntnccccaaaanttntnggggaacaangggcccnnttttttncccttttaatgccnagggggattccccaatttncancccc

SEQ ID NO: 4 - DNA, 726 bp, Homo sapiens
  misc_feature (725)..(726): n is a, c, g, or t
agaattactatgagaggtcgcatcccatcaccatcacggatcctatttaggtgacactatagaatcgtcgactctggaccttggctgtcactcagttaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaaatttccaagttgatcgtgatgttgatccgggactcggtgtggtgacggcccgccctgagcgcgaaagtgcacgctcttgacaacttccttatgtttggagctttctccaccaccacccccgcccattttcttgtaaaatttttgccatgcagatatgtaataactgcaagtaaaggctgaagacaatgtgagctgaacacggaactattann

SEQ ID NO: 5 - DNA, 963 bp, Homo sapiens
atgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaa

SEQ ID NO: 6 - DNA, 1284 bp, Homo sapiens
  misc_feature (1)..(2): n is a, c, g, or t
  misc_feature (5)..(5): n is a, c, g, or t
  misc_feature (828)..(828): n is a, c, g, or t
  misc_feature (852)..(852): n is a, c, g, or t
  misc_feature (917)..(917): n is a, c, g, or t
  misc_feature (933)..(933): n is a, c, g, or t
  misc_feature (941)..(941): n is a, c, g, or t
  misc_feature (943)..(943): n is a, c, g, or t
  misc_feature (953)..(953): n is a, c, g, or t
  misc_feature (961)..(961): n is a, c, g, or t
  misc_feature (992)..(992): n is a, c, g, or t
  misc_feature (1024)..(1024): n is a, c, g, or t
  misc_feature (1038)..(1039): n is a, c, g, or t
  misc_feature (1053)..(1053): n is a, c, g, or t
  misc_feature (1058)..(1058): n is a, c, g, or t
  misc_feature (1074)..(1074): n is a, c, g, or t
  misc_feature (1080)..(1080): n is a, c, g, or t
  misc_feature (1096)..(1096): n is a, c, g, or t
  misc_feature (1099)..(1099): n is a, c, g, or t
  misc_feature (1101)..(1101): n is a, c, g, or t
  misc_feature (1105)..(1105): n is a, c, g, or t
  misc_feature (1110)..(1110): n is a, c, g, or t
  misc_feature (1123)..(1123): n is a, c, g, or t
  misc_feature (1142)..(1142): n is a, c, g, or t
  misc_feature (1149)..(1149): n is a, c, g, or t
  misc_feature (1152)..(1152): n is a, c, g, or t
  misc_feature (1154)..(1155): n is a, c, g, or t
  misc_feature (1158)..(1158): n is a, c, g, or t
  misc_feature (1165)..(1165): n is a, c, g, or t
  misc_feature (1169)..(1169): n is a, c, g, or t
  misc_feature (1173)..(1173): n is a, c, g, or t
  misc_feature (1186)..(1186): n is a, c, g, or t
  misc_feature (1193)..(1193): n is a, c, g, or t
  misc_feature (1196)..(1196): n is a, c, g, or t
  misc_feature (1204)..(1204): n is a, c, g, or t
  misc_feature (1234)..(1234): n is a, c, g, or t
  misc_feature (1238)..(1238): n is a, c, g, or t
  misc_feature (1240)..(1240): n is a, c, g, or t
  misc_feature (1242)..(1242): n is a, c, g, or t
  misc_feature (1263)..(1263): n is a, c, g, or t
  misc_feature (1275)..(1275): n is a, c, g, or t
  misc_feature (1281)..(1282): n is a, c, g, or t
nnatngagaaattactatgagaggatcgcatcaccatcaccatcacggatcctatttaggtgacactatagaatcgtcgacccacgcgtccgcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaaagaggangcaacttttggctttggggattcncgtggtggcggtggaaatttatggaagtggaaattacaatgatttggaaatttataaccagcaanccttctaactacggtncaatgaanantggaaacttnggtggtancaggaacatgggggggaaccatatggtggangaaacttatggtcccagaaaggcattggaagnaaattggggggttnntggtgggaaggaancccanactgaaccttcttccnaatttngccaggggccttcccnggnanaaanagggnaagggatggaaanccccaaggtaaacaaaacncctttcnggntnnccnaaaaaanaatngttnaaggaaacctttncccccanccnggcaaaanatgccgggaaatgggcaaaaaaaccccaancaantncnaaaaccctttttgggaggggnttgggatttttnaaaaanntt

SEQ ID NO: 7 - DNA, 750 bp, Homo sapiens
atagagaattactatgagaggtcgcatcccatcaccatcacggatcctatttaggtgacactatagaatcgtcgactctggaccttggctgtcactcagtttatggggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccaggaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggccagcccctgggcagaagggtggccagtgggcccagcccctggggaggggatatccccccagtctggttcagccctcaagctcctgaaaacaaccacgaggtgcctg

SEQ ID NO: 8 - DNA, 1103 bp, Homo sapiens
  misc_feature (104)..(104): n is a, c, g, or t
  misc_feature (124)..(124): n is a, c, g, or t
  misc_feature (130)..(130): n is a, c, g, or t
  misc_feature (156)..(156): n is a, c, g, or t
  misc_feature (168)..(168): n is a, c, g, or t
  misc_feature (177)..(177): n is a, c, g, or t
  misc_feature (183)..(184): n is a, c, g, or t
  misc_feature (270)..(270): n is a, c, g, or t
  misc_feature (281)..(281): n is a, c, g, or t
  misc_feature (304)..(304): n is a, c, g, or t
  misc_feature (314)..(314): n is a, c, g, or t
  misc_feature (326)..(326): n is a, c, g, or t
  misc_feature (357)..(357): n is a, c, g, or t
  misc_feature (359)..(359): n is a, c, g, or t
  misc_feature (377)..(377): n is a, c, g, or t
  misc_feature (391)..(391): n is a, c, g, or t
  misc_feature (395)..(395): n is a, c, g, or t
  misc_feature (410)..(410): n is a, c, g, or t
  misc_feature (412)..(412): n is a, c, g, or t
  misc_feature (415)..(415): n is a, c, g, or t
  misc_feature (524)..(524): n is a, c, g, or t
  misc_feature (527)..(527): n is a, c, g, or t
  misc_feature (664)..(664): n is a, c, g, or t
  misc_feature (687)..(687): n is a, c, g, or t
  misc_feature (702)..(702): n is a, c, g, or t
  misc_feature (707)..(707): n is a, c, g, or t
  misc_feature (721)..(722): n is a, c, g, or t
  misc_feature (761)..(762): n is a, c, g, or t
  misc_feature (778)..(778): n is a, c, g, or t
  misc_feature (782)..(782): n is a, c, g, or t
  misc_feature (792)..(792): n is a, c, g, or t
  misc_feature (817)..(817): n is a, c, g, or t
  misc_feature (819)..(819): n is a, c, g, or t
  misc_feature (858)..(858): n is a, c, g, or t
  misc_feature (869)..(869): n is a, c, g, or t
  misc_feature (872)..(872): n is a, c, g, or t
  misc_feature (874)..(874): n is a, c, g, or t
  misc_feature (878)..(878): n is a, c, g, or t
  misc_feature (891)..(892): n is a, c, g, or t
  misc_feature (894)..(894): n is a, c, g, or t
  misc_feature (897)..(897): n is a, c, g, or t
  misc_feature (902)..(902): n is a, c, g, or t
  misc_feature (911)..(911): n is a, c, g, or t
  misc_feature (919)..(919): n is a, c, g, or t
  misc_feature (941)..(941): n is a, c, g, or t
  misc_feature (946)..(946): n is a, c, g, or t
  misc_feature (950)..(950): n is a, c, g, or t
  misc_feature (966)..(966): n is a, c, g, or t
  misc_feature (968)..(968): n is a, c, g, or t
  misc_feature (974)..(974): n is a, c, g, or t
  misc_feature (989)..(989): n is a, c, g, or t
  misc_feature (993)..(994): n is a, c, g, or t
  misc_feature (1011)..(1011): n is a, c, g, or t
  misc_feature (1019)..(1019): n is a, c, g, or t
  misc_feature (1026)..(1026): n is a, c, g, or t
  misc_feature (1035)..(1035): n is a, c, g, or t
  misc_feature (1041)..(1041): n is a, c, g, or t
  misc_feature (1059)..(1059): n is a, c, g, or t
  misc_feature (1074)..(1074): n is a, c, g, or t
  misc_feature (1077)..(1077): n is a, c, g, or t
  misc_feature (1084)..(1084): n is a, c, g, or t
  misc_feature (1090)..(1090): n is a, c, g, or t
  misc_feature (1094)..(1096): n is a, c, g, or t
  misc_feature (1098)..(1098): n is a, c, g, or t
tagagaaattactatgagaggatcgcatcaccatcaccatcacggatcctatttaggtgacactatagaatcgtcgacccacgcgtccggtttcattgtgggancattacaactgtgggctccnagtcanatgcagcagatccgcatgtcccttcncgggaaggctgnggtgctgangggcannaacaccatgatgcgcaaggccatccgagggcacctggaaaacaacccagctctggagaaactgctgcctcatatccgggggaatgngggctttgtgntcaccaaggaggacctcactganatcagggacntgttgctggccnataaggtgccagctgctgcccgtgctggtgncnttgccccatgtgaagtcnctgtgccagcccanaacnctggtctcgggcccnanaanacctcctttttccaggctttaggtatcaccactaaaatctccaggggcaccattgaaatcctgagtgatgtgcagctgatcaagactggagacaaagtgggagccagcnaanccacgctgctgaacatgctcaacatctcccccttctcctttgggctggtcatccagcaggtgttcgacaatggcagcatctacaaccctgaagtgcttgatatcacagaggaaactctgcattctcgcttcctgganggtgtccgcaatgttgccagtgnctgtctgcagattgnctacncaactgttgcatcnntaccccattctatcatcaacgggtacaaacgagtcctgnncttgtctgtggaaacngatnacaccttccnacttgctgaaaaagtcaaggccttncntggctgatccatctgcctttgtggctagctgcccctgtnactgctgccanaananctgnttcctgctgctgnngnaancccanctaaaggtngaaacccnaagaaaaaatccgaaggaatcngaacnaagnatatgggaatttgggncncctttnactaaatccccccanaaannaaccctactttaacccngtttttantttgccnaaacaaagnaaaatnaagggcttaacttctttnaaaaaaaaaaaaaanaangggcggnccgccncccnnnanggggg

SEQ ID NO: 9 - DNA, 544 bp, Homo sapiens
tagagaaattaactatgagaggatcgcatcaccatcaccatcacggatcctatttaggtgacactatagaatcgtcgacccacgcgtccggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 10 - DNA, 486 bp, Homo sapiens
tactatgagaggtcgcatcaccatcaccatcacggatcctatttaggtgacactatagaatcgtcgactctggaccttggctgtcactcagttgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatct

SEQ ID NO: 11 - DNA, 857 bp, Homo sapiens
  misc_feature (797)..(798): n is a, c, g, or t
ccatagagagaatactatgagaggatgcatcaccatcaccatcacggatcctatttaggtgacactatagaatcgtcgactctggaccttggctgtcactcagttaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacnnatcaaatgaatactttgatcatgaaatgtcacattattcatcctgagtccgaagactca

SEQ ID NO: 12 - DNA, 848 bp, Homo sapiens
  misc_feature (1)..(3): n is a, c, g, or t
  misc_feature (711)..(711): n is a, c, g, or t
  misc_feature (782)..(782): n is a, c, g, or t
  misc_feature (789)..(789): n is a, c, g, or t
  misc_feature (796)..(796): n is a, c, g, or t
  misc_feature (803)..(803): n is a, c, g, or t
  misc_feature (811)..(811): n is a, c, g, or t
  misc_feature (816)..(817): n is a, c, g, or t
  misc_feature (828)..(833): n is a, c, g, or t
  misc_feature (835)..(842): n is a, c, g, or t
  misc_feature (844)..(845): n is a, c, g, or t
  misc_feature (847)..(848): n is a, c, g, or t
nnnaagatatattgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgggattctgttgtgtcataattcactctcgccacgaagagagtcttgaagtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccgggccctccccgcttccgcacagggaccgggaccgggaccgtgagcgggagcgcaaaaagcggaaccgggaacaaaacaggagccagaacgggcaagctcccgcccccgggaccggcggaagggctcacggaanccccacaaggaggacgggaggccccccgggaacggaacaaggaacaggacgggaccggaaacgggaaaccncccgaancggaaanggccccnggggaaanggaanncaggaagaacnnnnnngnnnnnnnngnnann

SEQ ID NO: 13 - DNA, 977 bp, Homo sapiens
  misc_feature (1)..(1): n is a, c, g, or t
  misc_feature (896)..(896): n is a, c, g, or t
  misc_feature (914)..(914): n is a, c, g, or t
  misc_feature (918)..(918): n is a, c, g, or t
  misc_feature (925)..(925): n is a, c, g, or t
  misc_feature (958)..(958): n is a, c, g, or t
  misc_feature (965)..(967): n is a, c, g, or t
  misc_feature (969)..(969): n is a, c, g, or t
  misc_feature (971)..(971): n is a, c, g, or t
  misc_feature (973)..(973): n is a, c, g, or t
  misc_feature (976)..(976): n is a, c, g, or t
naatagagaaattactatgagaggatcgcatcaccatcaccatcacggatcctatttaggtgacactatagaatcgtcgacccacgcgtccgatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggttttcccttacagggccccctcccccgggaatgcgcccaccaaggccctaaactcatcttggccctcctcaactccctgcctgtttcccgtaagctgtanataatcctttttatctcntgtngcctatnaaactggtttaaaaaaaaactccttaaaaaaancttttannnanananaana

SEQ ID NO: 14 - DNA, 915 bp, Homo sapiens
  misc_feature (11)..(11): n is a, c, g, or t
  misc_feature (797)..(797): n is a, c, g, or t
  misc_feature (819)..(819): n is a, c, g, or t
  misc_feature (824)..(824): n is a, c, g, or t
  misc_feature (865)..(865): n is a, c, g, or t
  misc_feature (873)..(873): n is a, c, g, or t
  misc_feature (886)..(887): n is a, c, g, or t
  misc_feature (896)..(896): n is a, c, g, or t
  misc_feature (907)..(908): n is a, c, g, or t
  misc_feature (914)..(914): n is a, c, g, or t
atagagaaatnactatgagaggatcgcatcaccatcaccatcacggaatcctatttaggtgacactatagaatcgtcgacccacgcgtccgagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccggnaatgagaccccctccaccaggnattanaggtccacctccccccaggaatgcgtccaccaagaccttancatactgntgatccatctcanncactttttnccctgcaatgnntcttgng

SEQ ID NO: 15 - DNA, 1443 bp, Homo sapiens
atggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattag

SEQ ID NO: 16 - DNA, 1165 bp, Homo sapiens
  misc_feature (892)..(892): n is a, c, g, or t
  misc_feature (913)..(913): n is a, c, g, or t
  misc_feature (919)..(919): n is a, c, g, or t
  misc_feature (921)..(921): n is a, c, g, or t
  misc_feature (931)..(931): n is a, c, g, or t
  misc_feature (942)..(942): n is a, c, g, or t
  misc_feature (990)..(990): n is a, c, g, or t
  misc_feature (995)..(995): n is a, c, g, or t
  misc_feature (1001)..(1001): n is a, c, g, or t
  misc_feature (1011)..(1011): n is a, c, g, or t
  misc_feature (1013)..(1013): n is a, c, g, or t
  misc_feature (1027)..(1027): n is a, c, g, or t
  misc_feature (1044)..(1044): n is a, c, g, or t
  misc_feature (1051)..(1051): n is a, c, g, or t
  misc_feature (1067)..(1067): n is a, c, g, or t
  misc_feature (1076)..(1076): n is a, c, g, or t
  misc_feature (1081)..(1081): n is a, c, g, or t
  misc_feature (1085)..(1085): n is a, c, g, or t
  misc_feature (1091)..(1092): n is a, c, g, or t
  misc_feature (1096)..(1096): n is a, c, g, or t
  misc_feature (1099)..(1099): n is a, c, g, or t
  misc_feature (1107)..(1107): n is a, c, g, or t
  misc_feature (1121)..(1121): n is a, c, g, or t
  misc_feature (1144)..(1145): n is a, c, g, or t
  misc_feature (1148)..(1148): n is a, c, g, or t
  misc_feature (1157)..(1157): n is a, c, g, or t
  misc_feature (1161)..(1161): n is a, c, g, or t
  misc_feature (1165)..(1165): n is a, c, g, or t
tagagaaattactatgagaggatcgcatcaccatcaccatcacggatcctatttaggtgacactatagaatcgtcgacccacgcgtccgcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgaaacatgccatctgtganattgctgccaactacaaaaanaaaaancncgtctttaanctgaagctgantatggcagcgagtggctcttccatggcaagaatgaagaagaaatgctntcctngcttcnagggcgtgancncccccatcaacgantcccaaaacatcccccntcaaggncaaaacctgcccctgnctttccttnccggncccnaacccnncctnggnaaaaaaanaaggaaaaaaaatnccccttttccccaaaaaaatacnnggnggggttggngggncccn

SEQ ID NO: 17 - DNA, 1415 bp, Homo sapiens
catatactgactacctataaataggcgtatccgaggccctttcgtcttcacctcgagaaatcataaaaaatttatttgctttgtgagcggataacaattataatagattcaattgtgagcggataacaatttcccacagaattcattaaagaggagaaattaactatgagaggatcgcatcaccatcaccatcacggtcgacccacgcgtccgcggaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctacaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaaccaagaactgacttgggaagtactagaaggagaggtggaaaaagaagccctgaagaaaataatacaagacccacaagaatccctacacaaatggaagtcaaaacgtccgaaatttaaacggaaaaggaagggtaataaagcttgccccccctgggtctggtaaaggaaaagtacagtttcagggcaaaaaacgcaatttgctagcgatcatgaacatgaccaacatgatgaaaaagggtgcaactggaccctgggaaaacagcagaagaaaaacccgccaccgaaataccccgcctccccacccaccgaaaacccaaacagggcgcctgggagacccctaatttcaccaaccccctttttctatctccttttaaaaacggcttagaccaacccttggctaccgcgggctttcaaacggcaaaccccactcagggccccctccatgggcccgccgggccgaaagcggaaactctctctcggcggcccacctcgtcctctctcctagccccaagcaagaaccctcatagacgcactcgcacccggctgggcgacaacccgccaccacatctgcgcaactcacaagccccggcgtgggggccccccgccagaccaaccagaacccgcccccacgaccccgacgcagccgtgttcgaaccacagccgcggccctcagatcgctttactccccacgcaaacccgacaagcactacgaaaactatcctagcaacctcgagatgctcacagccgaaatacatatggaccgctacacgcgccacaggtgaccgtacgacagagcacagaaccgtctaccctctcaccgcgctg

SEQ ID NO: 18 - DNA, 1105 bp, Homo sapiens
  misc_feature (760)..(760): n is a, c, g, or t
  misc_feature (793)..(793): n is a, c, g, or t
  misc_feature (817)..(817): n is a, c, g, or t
  misc_feature (839)..(839): n is a, c, g, or t
  misc_feature (887)..(887): n is a, c, g, or t
  misc_feature (894)..(894): n is a, c, g, or t
  misc_feature (914)..(914): n is a, c, g, or t
  misc_feature (920)..(920): n is a, c, g, or t
  misc_feature (925)..(925): n is a, c, g, or t
  misc_feature (928)..(928): n is a, c, g, or t
  misc_feature (937)..(937): n is a, c, g, or t
  misc_feature (940)..(940): n is a, c, g, or t
  misc_feature (951)..(951): n is a, c, g, or t
  misc_feature (963)..(963): n is a, c, g, or t
  misc_feature (979)..(979): n is a, c, g, or t
  misc_feature (991)..(991): n is a, c, g, or t
  misc_feature (996)..(996): n is a, c, g, or t
  misc_feature (1000)..(1001): n is a, c, g, or t
  misc_feature (1005)..(1005): n is a, c, g, or t
  misc_feature (1017)..(1017): n is a, c, g, or t
  misc_feature (1020)..(1020): n is a, c, g, or t
  misc_feature (1025)..(1025): n is a, c, g, or t
  misc_feature (1029)..(1029): n is a, c, g, or t
  misc_feature (1035)..(1035): n is a, c, g, or t
  misc_feature (1040)..(1040): n is a, c, g, or t
  misc_feature (1047)..(1048): n is a, c, g, or t
  misc_feature (1055)..(1056): n is a, c, g, or t
  misc_feature (1059)..(1059): n is a, c, g, or t
  misc_feature (1061)..(1061): n is a, c, g, or t
  misc_feature (1063)..(1063): n is a, c, g, or t
  misc_feature (1067)..(1067): n is a, c, g, or t
  misc_feature (1070)..(1070): n is a, c, g, or t
  misc_feature (1075)..(1075): n is a, c, g, or t
  misc_feature (1085)..(1085): n is a, c, g, or t
  misc_feature (1089)..(1089): n is a, c, g, or t
  misc_feature (1101)..(1101): n is a, c, g, or t
tgagaaattactatgagaggatcgcatcaccatcaccatcacggatcctatttaggtgacactatagaatcgtcgacccacgcgtccgcggacgcgtgggcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaaactctaaaatanagctcaagcttgagaaaagaaaaaccactaaangggcagaccaaagactccagtaanactcaagcaaaaaaaatttgancacaattcaaagctttttttcaacttggaataacttgaaaactgaatnggacaantggatttttcaaaaaggggnaacctntgcangcnttttactanggnaatctaaaaanaagggttcaaanaaaaaaattccaaggnaaaaaggggtgnaaaantttnnaaantttttttttaanaanatggntccnaattanttttnaaaaaannatccccnnaancntnaaanttntaatnggcttttaancaanaaaattcctttntttt

SEQ ID NO: 19 - DNA, 1240 bp, Homo sapiens
  misc_feature (836)..(836): n is a, c, g, or t
  misc_feature (876)..(876): n is a, c, g, or t
  misc_feature (902)..(902): n is a, c, g, or t
  misc_feature (908)..(908): n is a, c, g, or t
  misc_feature (914)..(914): n is a, c, g, or t
  misc_feature (921)..(921): n is a, c, g, or t
  misc_feature (923)..(923): n is a, c, g, or t
  misc_feature (941)..(941): n is a, c, g, or t
  misc_feature (967)..(967): n is a, c, g, or t
  misc_feature (1024)..(1024): n is a, c, g, or t
  misc_feature (1050)..(1050): n is a, c, g, or t
  misc_feature (1055)..(1055): n is a, c, g, or t
  misc_feature (1065)..(1065): n is a, c, g, or t
  misc_feature (1068)..(1068): n is a, c, g, or t
  misc_feature (1071)..(1071): n is a, c, g, or t
  misc_feature (1074)..(1074): n is a, c, g, or t
  misc_feature (1088)..(1088): n is a, c, g, or t
  misc_feature (1108)..(1108): n is a, c, g, or t
  misc_feature (1118)..(1118): n is a, c, g, or t
  misc_feature (1128)..(1128): n is a, c, g, or t
  misc_feature (1134)..(1134): n is a, c, g, or t
  misc_feature (1140)..(1140): n is a, c, g, or t
  misc_feature (1143)..(1143): n is a, c, g, or t
  misc_feature (1146)..(1146): n is a, c, g, or t
  misc_feature (1148)..(1148): n is a, c, g, or t
  misc_feature (1154)..(1154): n is a, c, g, or t
  misc_feature (1158)..(1158): n is a, c, g, or t
  misc_feature (1171)..(1171): n is a, c, g, or t
  misc_feature (1175)..(1175): n is a, c, g, or t
  misc_feature (1187)..(1187): n is a, c, g, or t
  misc_feature (1204)..(1204): n is a, c, g, or t
  misc_feature (1209)..(1209): n is a, c, g, or t
  misc_feature (1215)..(1215): n is a, c, g, or t
  misc_feature (1219)..(1219): n is a, c, g, or t
  misc_feature (1225)..(1225): n is a, c, g, or t
  misc_feature (1227)..(1227): n is a, c, g, or t
  misc_feature (1238)..(1239): n is a, c, g, or t
tagagaaattactatgagaggatcgcatcaccatcaccatcacggatcctatttaggtgacactatagaatcgtcgacccacgcgtccggacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtanatgtgacaggaaaggaggcctgggacctgggtgtctgcanagactctgtgcgcaggaaggggcacntttttngcttanttccaanantggcttctggacaatttnggttgtggaacaaacaaaaatatgangctggcacctaccccccaaactccccctccccctttcaggtgcctcccatgccaagnttgggatttttcctggactttgaagnctggnatggttctcnttnttnaanatcccttgaacaanggctcccctcatctactccnttctttgaangggccctttnaagganctttgnggnccntntttcantccnggtttccatgganggangaaaaaaacaanccccccttaaccctttntcccntgaaanttgnattccnangggtcccccgnnc

SEQ ID NO: 20 - DNA, 1135 bp, Homo sapiens
  misc_feature (2)..(2): n is a, c, g, or t
  misc_feature (835)..(835): n is a, c, g, or t
  misc_feature (943)..(943): n is a, c, g, or t
  misc_feature (962)..(962): n is a, c, g, or t
  misc_feature (973)..(973): n is a, c, g, or t
  misc_feature (977)..(977): n is a, c, g, or t
  misc_feature (985)..(985): n is a, c, g, or t
  misc_feature (987)..(987): n is a, c, g, or t
  misc_feature (992)..(992): n is a, c, g, or t
  misc_feature (1002)..(1002): n is a, c, g, or t
  misc_feature (1005)..(1005): n is a, c, g, or t
  misc_feature (1015)..(1015): n is a, c, g, or t
  misc_feature (1017)..(1018): n is a, c, g, or t
  misc_feature (1029)..(1029): n is a, c, g, or t
  misc_feature (1036)..(1036): n is a, c, g, or t
  misc_feature (1052)..(1052): n is a, c, g, or t
  misc_feature (1062)..(1062): n is a, c, g, or t
  misc_feature (1064)..(1065): n is a, c, g, or t
  misc_feature (1067)..(1067): n is a, c, g, or t
  misc_feature (1084)..(1084): n is a, c, g, or t
  misc_feature (1086)..(1086): n is a, c, g, or t
  misc_feature (1088)..(1088): n is a, c, g, or t
  misc_feature (1106)..(1106): n is a, c, g, or t
  misc_feature (1110)..(1110): n is a, c, g, or t
  misc_feature (1117)..(1117): n is a, c, g, or t
  misc_feature (1120)..(1120): n is a, c, g, or t
  misc_feature (1124)..(1124): n is a, c, g, or t
  misc_feature (1128)..(1129): n is a, c, g, or t
  misc_feature (1134)..(1135): n is a, c, g, or t
antagagaaattactatgagaggatcgcatcaccatcaccatcacggatcctatttaggtgacactatagaatcgtcgacccacgcgtccggtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattanaaacttacaagacaggtcatggtctcagagggaaactgaagtggcgccctgatgaaaaaattttgaaagcattggatgctgctttttataaaacatttaaaaacagtngaaccaactgggaaaacgntttcttactanctgntgatgtcngngcctnctatgaaccnaanagttttgggnannataccccaacnctatacngttgctgcaccaatgngcagggttgncnncnaacaaaaaaaatcttangnanttgcttttcccaagaaangggnccctggnccngggncaannaaaann

SEQ ID NO: 21 - DNA, 1226 bp, Homo sapiens
  misc_feature (795)..(795): n is a, c, g, or t
  misc_feature (908)..(908): n is a, c, g, or t
  misc_feature (923)..(923): n is a, c, g, or t
  misc_feature (928)..(928): n is a, c, g, or t
  misc_feature (947)..(947): n is a, c, g, or t
  misc_feature (969)..(969): n is a, c, g, or t
  misc_feature (975)..(975): n is a, c, g, or t
  misc_feature (985)..(985): n is a, c, g, or t
  misc_feature (1010)..(1010): n is a, c, g, or t
  misc_feature (1019)..(1019): n is a, c, g, or t
  misc_feature (1022)..(1022): n is a, c, g, or t
  misc_feature (1024)..(1024): n is a, c, g, or t
  misc_feature (1056)..(1056): n is a, c, g, or t
  misc_feature (1066)..(1066): n is a, c, g, or t
  misc_feature (1071)..(1071): n is a, c, g, or t
  misc_feature (1081)..(1081): n is a, c, g, or t
  misc_feature (1086)..(1086): n is a, c, g, or t
  misc_feature (1092)..(1092): n is a, c, g, or t
  misc_feature (1094)..(1094): n is a, c, g, or t
  misc_feature (1103)..(1103): n is a, c, g, or t
  misc_feature (1117)..(1117): n is a, c, g, or t
  misc_feature (1125)..(1125): n is a, c, g, or t
  misc_feature (1127)..(1127): n is a, c, g, or t
  misc_feature (1144)..(1144): n is a, c, g, or t
  misc_feature (1148)..(1148): n is a, c, g, or t
  misc_feature (1160)..(1160): n is a, c, g, or t
  misc_feature (1180)..(1180): n is a, c, g, or t
  misc_feature (1182)..(1182): n is a, c, g, or t
  misc_feature (1192)..(1192): n is a, c, g, or t
  misc_feature (1196)..(1196): n is a, c, g, or t
  misc_feature (1199)..(1199): n is a, c, g, or t
  misc_feature (1205)..(1205): n is a, c, g, or t
  misc_feature (1208)..(1208): n is a, c, g, or t
  misc_feature (1211)..(1211): n is a, c, g, or t
  misc_feature (1214)..(1214): n is a, c, g, or t
  misc_feature (1216)..(1216): n is a, c, g, or t
  misc_feature (1222)..(1222): n is a, c, g, or t
attagagaaattactatgagaggatcgcatcaccatcaccatcacggatcctatttaggtgacactatagaatcgtcgacccacgcgtccgctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgangctgccaaccggaacaatgacgccctgcgccaggcaaagcaggagtccactgagtaccggagacaggtgcagtccctcacctgtgaagtggatgcccttaaaggaacaatgantccttggaacgccanatgcntgaaatggaaaaaactttncgttgaactgctactaccaaanactatnggcccctgcnggatgaaattcaaatatgaagaagnaatggctcntcncnttcttgaaaccaaaactgctcatgttaaatgnccttgaattnaaatnccccttacgnaactnctgaangnaagaaaaangattttctgccctncaaatttncncctgaacctgaggaaanaacnggaatccccccngggtgaaccccccaaaagancnttttataaangttnaantaaaanggnggnttnanaaattntccc

SEQ ID NO: 22 - DNA, 1208 bp, Homo sapiens
  misc_feature (920)..(920): n is a, c, g, or t
  misc_feature (927)..(927): n is a, c, g, or t
  misc_feature (939)..(939): n is a, c, g, or t
  misc_feature (966)..(966): n is a, c, g, or t
  misc_feature (995)..(995): n is a, c, g, or t
  misc_feature (997)..(997): n is a, c, g, or t
  misc_feature (1005)..(1005): n is a, c, g, or t
  misc_feature (1018)..(1018): n is a, c, g, or t
  misc_feature (1027)..(1027): n is a, c, g, or t
  misc_feature (1035)..(1035): n is a, c, g, or t
  misc_feature (1071)..(1071): n is a, c, g, or t
  misc_feature (1078)..(1078): n is a, c, g, or t
  misc_feature (1081)..(1081): n is a, c, g, or t
  misc_feature (1083)..(1083): n is a, c, g, or t
  misc_feature (1086)..(1088): n is a, c, g, or t
  misc_feature (1092)..(1092): n is a, c, g, or t
  misc_feature (1100)..(1100): n is a, c, g, or t
  misc_feature (1107)..(1107): n is a, c, g, or t
  misc_feature (1111)..(1111): n is a, c, g, or t
  misc_feature (1123)..(1123): n is a, c, g, or t
  misc_feature (1137)..(1137): n is a, c, g, or t
  misc_feature (1139)..(1139): n is a, c, g, or t
  misc_feature (1147)..(1147): n is a, c, g, or t
  misc_feature (1151)..(1151): n is a, c, g, or t
  misc_feature (1153)..(1153): n is a, c, g, or t
  misc_feature (1156)..(1156): n is a, c, g, or t
  misc_feature (1160)..(1160): n is a, c, g, or t
  misc_feature (1171)..(1171): n is a, c, g, or t
  misc_feature (1176)..(1176): n is a, c, g, or t
  misc_feature (1180)..(1180): n is a, c, g, or t
  misc_feature (1186)..(1186): n is a, c, g, or t
  misc_feature (1191)..(1191): n is a, c, g, or t
  misc_feature (1205)..(1205): n is a, c, g, or t
aatagagaaattactatgagaggatcgcatcaccatcaccatcacggatcctatttaggtgacactatagaatcgtcgacccacgcgtccgatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttgggatactaatgaaacaccgtatttttatgaanagcatanactgcatccganccctccgggaagaagccattaagtttncaaaaaaacagcgcttttaacaacttccngnaagccctncagaaaaaggggnaattaacanttaaatcntttctgggaattggtggccaggaggaatttcctganccccaanagnanccnnngganttctgccncctgagnaacnaaaagtttcggncccccaaaaaaacnangggaaacncccncnttntttnaaaaggggganggganattntggaangaaanggcgggaggtgggnaac

SEQ ID NO: 23 - DNA, 1304 bp, Homo sapiens
  misc_feature (568)..(568): n is a, c, g, or t
  misc_feature (1170)..(1170): n is a, c, g, or t
  misc_feature (1199)..(1199): n is a, c, g, or t
  misc_feature (1265)..(1265): n is a, c, g, or t
  misc_feature (1287)..(1287): n is a, c, g, or t
  misc_feature (1299)..(1299): n is a, c, g, or t
cccccctaagagatactatagaggatcgcatcaccatcaccatcacggtcgacccacgcgtccgcccacgcgtccgggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcangatttccataaaaatgcagctgatgacagtgctgataaagtgaataaaaaccctacccctgcttacctggacctgttaaaaaagagatcagcagttgaaactcaggcaaataaactcatctgaagaacaaaggcgatgttactcctctccggatggcagtaccacccataaccttgaagttagcccccaagaaaaacaaacggaaaccggcgctgaatgcaaaaacggcccaagggggattgtcccgaaaaacctttaaattttcccgggggggtctttcaatttgcccgaaatttttttgaaaaaaaatttgtttccagaaacccgggcccttttgtacttcaagaatttttccccaaatttttttggggccccaaaaggggagcaaaaaaaccccgcggagcctaaaaaagtggaaaaaaccttttttaaaaaaccaaacccgggtcccccccattggtgggaaaaaatgtcccccccccctaattttaaaaccaaccccaatttttttccccacaccaaaaaccctcactcctaaagaagaaaaaaccctcttgccatacacccccccccttttcttaaaacacttttttttccccaanatccatttacctacaaaaaaaaatgagtncttggttcccacccccacacaaccataatattcaataacactccttcccacctaacaaaaaaaccnataccattctattaatcactcntcccacccactnaccaa

SEQ ID NO: 24 - DNA, 861 bp, Homo sapiens
  misc_feature (776)..(776): n is a, c, g, or t
  misc_feature (795)..(795): n is a, c, g, or t
agagatactatgagaggatcgcatcaccatcaccatcacggatcctatttaggtgacactatagaatcgtcgactctggaccttggctgtcactcagttcagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctggacctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccataccaatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagaccatcagcagcagcatcaggcagctgtgcggcagcagctggcaaaggcngaagctgccgctggcctgnccgtcatggaaactgctgtggaagcgctacccctggtggaagcacttgagatctaacctctggccg

SEQ ID NO: 25 - DNA, 526 bp, Homo sapiens
agagagatactatgagaggtcgcatcaccatcaccatcacggatcctatttaggtgacactatagaatcgtcgactctggaccttggctgtcactcagttgagagtgtagggctgctgacaaatgaactggccctggagaaggaggccacagagaagctgcggaagctcctggcctcccagagcagcggtctccgagggctgtgggactgcctgcccgcagacctagtgggcgagaggagtgcacaaagcaaagtagcggagtccctggaggagctgcgggcctgcatcagcaccctggtggatcggcaccgggaggcccagcaggtgctggctcggctgcaagaagagaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcag

SEQ ID NO: 26 - DNA, 1503 bp, Homo sapiens
cccccaaactaagaatactagagaggatgcatcccatcaccatcacggtcgacccacgcgtccggccgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctccagccatgatagagaacttcattgccaaatatgtctccctgcatgtcaggaacagtaaccggaccgccctgcacctctattccaacaccaccatcttttcacatcaaagaaacagcacctccaacaccaagccaattggacaggccccctattcacgaaaccggcacccacctctaaagaccccccagcccaccctccacctggtacccgataaaaaacgccacccctattcactgcacaccaactccacactcactcaacatacaacccctcccactccctaactctcatcaaccacatcccaacctctcaaacctccaccaccacccacttctcactatccccacaatcacccacccaccctcctcaccacaccatctccaccctcccccaccccaccaatcccacatctccatctcccccaccccaccaccccccattcccctccaccccatttcttcccccaaaccctaccacactccatccccatccatcacaatccacactctaccccaccaccctcctccaccctctctactccaacctcaatcactaacacctacacaccccaacaatcccacatcacgcctcacaccacactcaaccactctcacaactcatccccctaaaattccaacacacccctctatctactgcatcacctcactcacacttaccatactcctcacacacaaccctaaaccacacataccaccctacatctcaaccaccgcatcaccattccgcttccttccaaccacacaacacacataccttctcaactcaccacctccacactactcatacctttacatccacctcacacactacc

SEQ ID NO: 27 - DNA, 2680 bp, Homo sapiens
atgctgagcggtgaacgtgttctgcagaccgaacgtagcgttgaaagcagcagcattagcctggttccgggtacagattatggcacccaggaaagcattagtctgctggaagttagcaccctgggtaaagcaaaaaccgaaccgaataaatgtgttagccagtgtgcagcatttgaaaatccgaaaggtctgattcatggctgcagcaaagataatcgtaatgataccgaaggctttaaatatccgctgggtcatgaagttaaccatagccgtgaaaccagcattgaaatggaagaaagcgaactggatgcacagtatctgcagaatacctttaaagttagcaaacgtcagagctttgcaccgtttagcaatccgggtaatgccgaagaagaatgcgcaacctttagcgcacatagcggtagcctgaaaaaacagagcccgaaagttacctttgaatgcgaacagaaagaagaaaaccagggcaaaaacgaaagcaatatcaaaccggttcagaccgttaatattaccgcaggttttccggttgttggccagaaagataaaccggttgataatgccaaatgcagcattaaaggtggtagccgtttttgtctgagcagccagtttcgtggtaatgaaaccggtctgattaccccgaataaacatggtctgctgcagaatccgtatcgtattccgcctctgtttccgattaaaagctttgttaaaaccaaatgcaaaaaaaatctgctggaagaaaattttgaagaacattccatgagtccggaacgtgaaatgggcaatgaaaatattccgagcaccgttagcaccattagccgtaataatattcgcgaaaatgtgtttaaagaagccagcagcagcaacattaatgaagttggtagcagcaccaatgaagtgggtagctcaattaatgaaattggcagctccgatgaaaacattcaggcagaactgggtcgtaatcgtggtccgaaactgaatgcaatgctgcgtctgggtgttctgcagccggaagtttataaacagagcctgcctggtagcaattgtaaacatccggaaattaaaaaacaggaatatgaagaagttgttcagacggttaacaccgattttagcccgtatctgattagcgataatctggaacagccgatgggtagcagccatgcaagccaggtttgtagcgaaacaccggatgatctgctggatgatggtgaaattaaagaagataccagctttgccgaaaatgatatcaaagaaagcagcgcagtgtttagcaaaagcgttcagaaaggtgaactgagccgtagcccgagcccgtttacccatacccatctggcacagggttatcgtcgtggtgcaaaaaaactggaaagcagcgaagaaaatctgtcaagcgaagatgaagaactgccgtgttttcagcatctgctgtttggtaaagtgaataatattccgtcacagagcacacgccatagcaccgttgcaaccgaatgtctgagcaaaaataccgaagaaaacctgctgagcctgaaaaatagcctgaatgattgtagcaaccaggttattctggcaaaagcaagccaggaacatcatctgagcgaagaaaccaaatgtagcgcaagcctgtttagcagccagtgtagcgaactggaagatctgaccgcaaataccaatacccaggacccgtttctgattggtagcagtaaacaaatgcgtcatcagagcgaaagccagggtgttggtctgagcgataaagaactggttagtgatgatgaagaacgtggcaccggtctggaagaaaacaatcaagaagaacagagcatggatagcaatctgggtgaagcagcaagcggttgtgaaagcgaaaccagcgttagcgaagattgtagcggtctgagcagtcagagcgatattctgaccacccagcagcgtgataccatgcagcataatctgattaaactgcagcaggaaatggcagaactggaagcagttctggaacagcatggttcacagccgagcaatagctatccgagcattattagcgatagcagcgctctggaagatctgcgtaatccggaacagagcaccagcgaaaaagcagttctgaccagccagaaaagcagcgaatatccgattagccagaatccggaaggtctgtcagcagataaatttgaagttagcgcagatagcagcaccagcaaaaataaagaaccgggtgttgaacgtagcagcccgagcaaatgtccgagcctggatgatcgttggtatatgcatagctgtagcggtagtctgcagaatcgtaattatccgagccaggaagaactgattaaagttgttgatgtggaagaacagcagctggaagaaagtggtccgcatgatctgaccgaaaccagctatctgcctcgtcaggatctggaaggcaccccgtatctggaaagcggtattagcctgtttagtgatgatccggaaagcgatccgagcgaagatcgtgcaccggaaagcgcacgtgttggtaatattccgagtagcaccagcgcactgaaagttccgcagctgaaagttgcagaaagcgcacagagtccggcagcagcacataccaccgataccgcaggttataatgcaatggaagaatcagtgagccgtgaaaaaccgtaagcggccgcttaattaa

SEQ ID NO: 28 - DNA, 1305 bp, Homo sapiens
  misc_feature (1)..(2): n is a, c, g, or t
  misc_feature (13)..(13): n is a, c, g, or t
  misc_feature (818)..(818): n is a, c, g, or t
  misc_feature (892)..(892): n is a, c, g, or t
  misc_feature (1216)..(1216): n is a, c, g, or t
  misc_feature (1227)..(1227): n is a, c, g, or t
  misc_feature (1261)..(1261): n is a, c, g, or t
  misc_feature (1264)..(1264): n is a, c, g, or t
  misc_feature (1274)..(1274): n is a, c, g, or t
  misc_feature (1277)..(1279): n is a, c, g, or t
  misc_feature (1284)..(1285): n is a, c, g, or t
  misc_feature (1287)..(1287): n is a, c, g, or t
  misc_feature (1289)..(1291): n is a, c, g, or t
  misc_feature (1295)..(1296): n is a, c, g, or t
nnaagccaccccncctaagaatactagagaggatgcatcaccatcaccatcacggtcgacccacgcgtccggtgcttgctgaggctgcacttgctgacactgcagctgcgacgcggctaagaggcgcagagcgaggagtcgggatttggtcgcgagcggcgacggaagaatatgaagaactgcttcgttatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaagggatttctagcttgtctcatgccataagcaagcaaaaggaaagatanagttgatgagaacattcttccactggcgaatcggccatgtcagagcagacaggatgtttatgaaagtaaactanctgaccagtactaccagagaactttactgaagaaagtctggaaaggctgggggttccgtaaggcaaagcaaggggaaagatggggtaaaaaaaacttggcaagcaaagactgaaaaaaattgaatccaaattcccaggattagaagcccaggtggctaggtttcggggctttggaaatggcaaaactgaattcaaaaaggcacatggaaaggcccctttgagatccctaaaaaacttctggagggggggggcttaatcttgagcctgcaattttcaacaaaatggggggataaccccaaaaataaaagaaaaatgtcctggttnaaaaaaaaatnttcttttactccccccccaaccctaaaaaaaacngtnctcccacccnccnnnagaannanannntccnnttttaattt

SEQ ID NO: 29 - DNA, 613 bp, Homo sapiens
  misc_feature (5)..(5): n is a, c, g, or t
  misc_feature (11)..(11): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (23)..(23): n is a, c, g, or t
  misc_feature (26)..(28): n is a, c, g, or t
  misc_feature (78)..(78): n is a, c, g, or t
  misc_feature (82)..(82): n is a, c, g, or t
  misc_feature (540)..(540): n is a, c, g, or t
  misc_feature (613)..(613): n is a, c, g, or t
tttcntttgtngcggnanantantannngattaattgtagcggatacaatttacacagaattattaagaggagaaatnactntgagaggatcgcataccatcaccatcacggatcctatttaggtgacactatagaatcgtcgacccacgcgtccggatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattntccgggatgtggacctcaatggggatggacgagtggacttttgaagagtttgtccggatgatgtcccgctgan

SEQ ID NO: 30 - DNA, 638 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (607)..(608): n is a, c, g, or t
  misc_feature (615)..(615): n is a, c, g, or t
  misc_feature (617)..(617): n is a, c, g, or t
  misc_feature (619)..(619): n is a, c, g, or t
  misc_feature (621)..(621): n is a, c, g, or t
  misc_feature (623)..(623): n is a, c, g, or t
  misc_feature (625)..(625): n is a, c, g, or t
  misc_feature (629)..(638): n is a, c, g, or t
tngnggnaattactatgagaggatcgcatcaccatcaccatcacggatcctatttaggtgacactatagaatcgtcgacccacgcgtccggtgccatcctgcccgcactgaagcagaccccgaaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacgtaaaagcacacgatgaagcaggtatcgccttacctgttgaaactgaaaataaagcttgtttatttccaaaaaaaaaaannaaaaaananananananaaannnnnnnnnn

SEQ ID NO: 31 - DNA, 1181 bp, Homo sapiens
  misc_feature (1)..(2): n is a, c, g, or t
  misc_feature (828)..(828): n is a, c, g, or t
  misc_feature (889)..(889): n is a, c, g, or t
  misc_feature (910)..(910): n is a, c, g, or t
  misc_feature (943)..(943): n is a, c, g, or t
  misc_feature (949)..(949): n is a, c, g, or t
  misc_feature (963)..(963): n is a, c, g, or t
  misc_feature (975)..(975): n is a, c, g, or t
  misc_feature (981)..(981): n is a, c, g, or t
  misc_feature (990)..(990): n is a, c, g, or t
  misc_feature (1001)..(1001): n is a, c, g, or t
  misc_feature (1007)..(1007): n is a, c, g, or t
  misc_feature (1019)..(1019): n is a, c, g, or t
  misc_feature (1033)..(1033): n is a, c, g, or t
  misc_feature (1044)..(1044): n is a, c, g, or t
  misc_feature (1048)..(1049): n is a, c, g, or t
  misc_feature (1066)..(1066): n is a, c, g, or t
  misc_feature (1070)..(1070): n is a, c, g, or t
  misc_feature (1079)..(1079): n is a, c, g, or t
  misc_feature (1081)..(1081): n is a, c, g, or t
  misc_feature (1088)..(1088): n is a, c, g, or t
  misc_feature (1096)..(1097): n is a, c, g, or t
  misc_feature (1104)..(1104): n is a, c, g, or t
  misc_feature (1115)..(1116): n is a, c, g, or t
  misc_feature (1123)..(1123): n is a, c, g, or t
  misc_feature (1133)..(1134): n is a, c, g, or t
  misc_feature (1136)..(1137): n is a, c, g, or t
  misc_feature (1140)..(1141): n is a, c, g, or t
  misc_feature (1151)..(1153): n is a, c, g, or t
  misc_feature (1174)..(1175): n is a, c, g, or t
nnaatagagaaattactatgagaggatcgcatcaccatcaccatcacggatcctatttaggtgacactatagaatcgtcgacccacgcgtccgcgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccnggggaaaaggttggcctgtggcatcattgcacgctccgctggccttttccaaaaccccaancaaatctgctcttgcgatggncctcaccatctgggaagaaacgaagccggcccnatcccntggcaaagggcccnaaagaaattcancaaaancccccttgncccactttttnaacagnacctcccccttnggctctgttgctgncctccaagggnaaanncttttccacttccaaangggnccaaaaggnantttgccntgccccanncttttgnaaaacttcaannaaaaggncaagaacttnntnnggnntttccctttnnnaaaaaaaaaatttttattttnnttttgg

SEQ ID NO: 32 - DNA, 540 bp, Homo sapiens
atggatattgcaattcatcatccgtggattcgtcgtccgttttttccgtttcatagcccgagccgtctgtttgatcagttttttggtgaacatctgctggaaagcgacctgtttccgaccagcaccagcctgagcccgttttatctgcgtccgcctagctttctgcgtgcaccgagctggtttgataccggtctgagcgaaatgcgtctggaaaaagatcgttttagcgttaacctggacgtgaaacatttttcaccggaagaactgaaagtgaaagttctgggtgatgtgattgaagtgcatggtaaacatgaagaacgccaggatgaacatggttttattagccgtgaatttcaccgcaaatatcgtattccggcagatgttgatccgctgaccattaccagcagcctgagcagtgatggtgttctgaccgttaatggtccgcgtaaacaggttagcggtccggaacgtaccattccgattacccgtgaagaaaaaccggcagttaccgcagcaccgaaaaaataagcggccgcttga

SEQ ID NO: 33 - DNA, 1453 bp, Homo sapiens
  misc_feature (1)..(1): n is a, c, g, or t
  misc_feature (786)..(786): n is a, c, g, or t
  misc_feature (851)..(851): n is a, c, g, or t
  misc_feature (866)..(866): n is a, c, g, or t
  misc_feature (875)..(876): n is a, c, g, or t
  misc_feature (949)..(949): n is a, c, g, or t
nccccctgagagatacttgagaggatcgcatcaccatcaccatcacggtcgacccacgcgtccggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaacagcaagttgtgggtctggattcagaagaaatggnagagttgccaggagatgcctcccagaaagagcccaatccaattctaccatttccctttgagcagntaagaggagcccctncatcagaannccctgggtgtcccttctgctgcccaccaattcagtccagctggaatcaccccccccggggctaatcactcaancctccattacacagtccaatgaaaaagatgctccaacctacccaatccggttgagccctgttcccatcccactctgccagctgaaattccatatgcacaggttcccccagcttacctcaacaggcccatgattgccgcgtgaaaacccccctaaagaagtctccctcctgaacagccaatcctgcactaacctggccacttgatgccaccaaaccccttgggccccatgaaaacaaaacacgtggcaatcccccacctttttttctccaaatcggtgcccccacttccaatcataacacacctcgaggggcagggccccctctcctgccgctgtgaaccaccgtccatctaccctcctcacaacccaccagggccccctcctaaatagtgctccccctgctacacacactctttccatcgttcattcgtgacccatcaaccaacatcattcccgtctcactctccactcacacaccttctccacacctactctcctactccact

SEQ ID NO: 34 - DNA, 1328 bp, Homo sapiens
  misc_feature (952)..(952): n is a, c, g, or t
gagccggccctaagaatactatagaggatgcatcccatcaccatcacggtcgacccacgcgtccgacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactacccccgcttcctggagctcaagttcgggcccggggtcatcgagaacccccagtaccccaacccggcactgctgagtctgacgggaagcggctgaagccctgataacctcgcctttgtttttccggggtctggctggatgaagaaaaacctccgctgaccgatgatactagtaaggagatctccccaaagcaaccgagaaactccccatcatacaacttcttacgacaacttacaaactcgccccatcttccccaaaaactcacctacaccacaccctaaaccaccacctgtacttttcaacgcactgcacaccagtatccctgactcttcttccaacctacctccatctcctcccttcaactacaaaccacnaacatcctcccaccaccaaaacccaccaccccaacacccacactacacccctagcccctactccacaccacacacccaccaccacataactacctcacacatctccctctcccactcaatcacatcctacaacactcccacatcattcaaccctccattccacatttcactcccaccatccccttcccctcctctaccacacatcccctccccttcccccccatccttctcaacagacctatctataccccacgacacactcctcaccctcacacatctcccatacatcctctcatcctacccatccaccttcacttccacctactccaacatctcatccactccctcaatactccaccacactaccccccatctc

SEQ ID NO: 35 - DNA, 1186 bp, Homo sapiens
  misc_feature (866)..(866): n is a, c, g, or t
  misc_feature (947)..(947): n is a, c, g, or t
  misc_feature (978)..(978): n is a, c, g, or t
  misc_feature (985)..(985): n is a, c, g, or t
  misc_feature (996)..(996): n is a, c, g, or t
  misc_feature (1020)..(1020): n is a, c, g, or t
  misc_feature (1030)..(1030): n is a, c, g, or t
  misc_feature (1042)..(1042): n is a, c, g, or t
  misc_feature (1047)..(1047): n is a, c, g, or t
  misc_feature (1052)..(1052): n is a, c, g, or t
  misc_feature (1055)..(1055): n is a, c, g, or t
  misc_feature (1070)..(1070): n is a, c, g, or t
  misc_feature (1082)..(1083): n is a, c, g, or t
  misc_feature (1096)..(1096): n is a, c, g, or t
  misc_feature (1098)..(1098): n is a, c, g, or t
  misc_feature (1104)..(1104): n is a, c, g, or t
  misc_feature (1106)..(1107): n is a, c, g, or t
  misc_feature (1110)..(1110): n is a, c, g, or t
  misc_feature (1120)..(1120): n is a, c, g, or t
  misc_feature (1124)..(1124): n is a, c, g, or t
  misc_feature (1138)..(1138): n is a, c, g, or t
  misc_feature (1140)..(1140): n is a, c, g, or t
  misc_feature (1150)..(1150): n is a, c, g, or t
  misc_feature (1152)..(1153): n is a, c, g, or t
  misc_feature (1176)..(1178): n is a, c, g, or t
  misc_feature (1186)..(1186): n is a, c, g, or t
tagagaaattactatgagaggatcgcatcaccatcaccatcacggatcctatttaggtgacactatagaatcgtcgacccacgcgtccgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacagcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatanagtgggctatcaatgctgctaccttgtcacagttttacatcaataagctatgctttatggaggccaggcactgtttatcanctgctaatgtcatttttggtcaactggaaanatctcanccacaaaaaanactcctgaaactgaaggaaaattnccaaactttntcttcaaaaaanggggnaatancanggtgctgaatcaaanactgtttgattnnatgcaaaatgccnantttccntnnagnaaaaataagnaaantttgattttaaaanantttgaatttnanntttttgggaaaaaaaactttttnnnggggaaan

SEQ ID NO: 36 - DNA, 1328 bp, Homo sapiens
  misc_feature (891)..(891): n is a, c, g, or t
tcgacttacctataaaaggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagagacacctggaggttagcaacggaatggacgagctggcaggtagcccatttcctgtgacgagaatgtcttcaagatcaagtgacgcaaaaccactgcccgcgtcctatccagctgaacctagggagccccaggaaactccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccacggccgcgatccgcatgcgagctcgattagctgagcttggactcctgttgatagatccagtaatgacctcagaactccatctggatttgttcaaaacgctcggntgccgccggcgtttttttattggtgagaatccaagctagcttggcgagattttcaggagctaaggaagctaaaatgaagaaaaaatcactggatatccaccgttgatatatcccaatgccatcgtaaagaacatttgaggcatttcagtcatttgctcatgtacctttaccagaacggtcactggatattcgggctttttaaaaccgtaaaaaaaataacccaattttatcggcctttattcctttttggcgcccgaagaaggtctccgaatttcaatggaaagaaaaagggactgggaataggaaaagttcacccttttaaccgcttctttaaaaaatgaaatttctttcttctggagaaaaaaaacaatttcgagattctccatattctcagaagtggggtacggaaacacgctttttccaaaggtatataaaat

SEQ ID NO: 37 - DNA, 1311 bp, Homo sapiens
  misc_feature (1)..(1): n is a, c, g, or t
  misc_feature (8)..(13): n is a, c, g, or t
nagaacannnnnngcaatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgcagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaagtccccccaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacccggccgcgatccgcatgcgagctcgattagctgagcttggactcctgttgatagatccagtaatgacctcagaactccatctggatttgttcagaacgctcggttgccgccgggcgttttttattggtgagaatccaagctagcttggcgagattttcaggagctaaggaagctaaaatggagaaaaaatcactggatatacaccgttgatatatcccaatggcatcgtaaagaacattttgaggcatttcagtcagttgctcaatgtacctataaccagaccgttcagctggatattacggcccttttaaagacccgtaagaaaaataagccaagttttatccggcctttatttccatccttgccgcctggatgaagctcatccggaattccaaggccaagaaaaacggtgaccgggggaaagggaaaagggtccccctgttacacggttttcctgaaccactggaaagttttctccctccggaggaaaacccaaaaatttccgggagtttcacaaaatttcccaaaaatgggggttacgggaaaactggcctatttcctaagggttttggaaaattttttcccctccccaccccggggggttccccatttatttaacagggccaaaggaaactttccccccgtttcccgggggaatatacacg

SEQ ID NO: 38 - DNA, 885 bp, Homo sapiens
  misc_feature (513)..(513): n is a, c, g, or t
  misc_feature (544)..(544): n is a, c, g, or t
  misc_feature (551)..(551): n is a, c, g, or t
  misc_feature (556)..(556): n is a, c, g, or t
  misc_feature (565)..(565): n is a, c, g, or t
  misc_feature (582)..(582): n is a, c, g, or t
  misc_feature (613)..(613): n is a, c, g, or t
  misc_feature (619)..(619): n is a, c, g, or t
  misc_feature (655)..(655): n is a, c, g, or t
  misc_feature (669)..(669): n is a, c, g, or t
  misc_feature (675)..(675): n is a, c, g, or t
  misc_feature (681)..(681): n is a, c, g, or t
  misc_feature (685)..(685): n is a, c, g, or t
  misc_feature (699)..(699): n is a, c, g, or t
  misc_feature (701)..(701): n is a, c, g, or t
  misc_feature (718)..(718): n is a, c, g, or t
  misc_feature (721)..(721): n is a, c, g, or t
  misc_feature (723)..(723): n is a, c, g, or t
  misc_feature (727)..(727): n is a, c, g, or t
  misc_feature (736)..(736): n is a, c, g, or t
  misc_feature (744)..(744): n is a, c, g, or t
  misc_feature (750)..(750): n is a, c, g, or t
  misc_feature (766)..(766): n is a, c, g, or t
  misc_feature (779)..(780): n is a, c, g, or t
  misc_feature (815)..(815): n is a, c, g, or t
  misc_feature (825)..(825): n is a, c, g, or t
  misc_feature (831)..(831): n is a, c, g, or t
  misc_feature (834)..(834): n is a, c, g, or t
  misc_feature (838)..(839): n is a, c, g, or t
  misc_feature (845)..(845): n is a, c, g, or t
  misc_feature (850)..(850): n is a, c, g, or t
  misc_feature (852)..(852): n is a, c, g, or t
  misc_feature (879)..(879): n is a, c, g, or t
  misc_feature (881)..(881): n is a, c, g, or t
cttaagaggagaattaactatgagaggatcgcatcaccatcaccatcacggatcctatttaggtgacactatagaatcgtcgacccacgcgtccgaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatggaatanatgacgggattagaatgtatacccatgtaanttttganttcanctgccaccnaaatgaaaaccattggntttcctattttaacttggcctttttttcctnaattcnaaacccagcataactcctcaagtttgtttttggaancttgaaaaaaaaanttttcntttganaacncccaggcccccacngnaactttttaaccgggangcnancccnatattcccngttataantcaggncccccaaccgttttgnccagggaattaanntggggtaaaaatttgtctcttaccaccggggaaanttttagcccnaaaagngtnaaannccgatnggggngnttggccaaattttttgggggacctttnantttt

SEQ ID NO: 39 - DNA, 1179 bp, Homo sapiens
  misc_feature (3)..(5): n is a, c, g, or t
  misc_feature (8)..(10): n is a, c, g, or t
  misc_feature (13)..(13): n is a, c, g, or t
  misc_feature (17)..(18): n is a, c, g, or t
  misc_feature (22)..(23): n is a, c, g, or t
  misc_feature (28)..(28): n is a, c, g, or t
  misc_feature (38)..(38): n is a, c, g, or t
  misc_feature (42)..(43): n is a, c, g, or t
  misc_feature (58)..(58): n is a, c, g, or t
  misc_feature (72)..(72): n is a, c, g, or t
  misc_feature (113)..(113): n is a, c, g, or t
  misc_feature (838)..(838): n is a, c, g, or t
  misc_feature (870)..(870): n is a, c, g, or t
  misc_feature (959)..(959): n is a, c, g, or t
  misc_feature (984)..(984): n is a, c, g, or t
  misc_feature (1000)..(1000): n is a, c, g, or t
  misc_feature (1004)..(1004): n is a, c, g, or t
  misc_feature (1036)..(1036): n is a, c, g, or t
  misc_feature (1055)..(1055): n is a, c, g, or t
  misc_feature (1058)..(1058): n is a, c, g, or t
  misc_feature (1060)..(1060): n is a, c, g, or t
  misc_feature (1065)..(1065): n is a, c, g, or t
  misc_feature (1068)..(1068): n is a, c, g, or t
  misc_feature (1079)..(1079): n is a, c, g, or t
  misc_feature (1082)..(1082): n is a, c, g, or t
  misc_feature (1090)..(1091): n is a, c, g, or t
  misc_feature (1095)..(1095): n is a, c, g, or t
  misc_feature (1108)..(1108): n is a, c, g, or t
  misc_feature (1111)..(1111): n is a, c, g, or t
  misc_feature (1124)..(1124): n is a, c, g, or t
  misc_feature (1139)..(1140): n is a, c, g, or t
  misc_feature (1142)..(1143): n is a, c, g, or t
  misc_feature (1152)..(1152): n is a, c, g, or t
  misc_feature (1154)..(1154): n is a, c, g, or t
  misc_feature (1157)..(1157): n is a, c, g, or t
  misc_feature (1165)..(1165): n is a, c, g, or t
  misc_feature (1177)..(1177): n is a, c, g, or t
gannnggnnnttncggnnagannattgnatcaccatcnccannacggatcctatttangtgacagctatagnatcgtcgacccacgcgtccgggaaagctctggctttcaggntagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgangattttggaaatcggctaatgcctgccttcanaacaccatccaagattccttactcggatgtgaacatcggtactggagttgcccacccgccacggtggacctccgacagcactgtggccnaagaggcattggaaaaggtgaacancacatcccggcctgtntggnaaaaagatgggctggtgcccatgttcatcaanacccacagtggcctcttcnccncntgggngtnttcccctgggnccngggccaannctanttgataactgctnaancatgattccgggngggaaacagaaaaanntnntggaaaaancntgnaacccttnagggtttaaaancc

SEQ ID NO: 40 - DNA, 1302 bp, Homo sapiens
  misc_feature (1)..(1): n is a, c, g, or t
  misc_feature (4)..(4): n is a, c, g, or t
  misc_feature (935)..(935): n is a, c, g, or t
  misc_feature (958)..(958): n is a, c, g, or t
  misc_feature (971)..(971): n is a, c, g, or t
  misc_feature (975)..(975): n is a, c, g, or t
  misc_feature (996)..(996): n is a, c, g, or t
  misc_feature (1011)..(1011): n is a, c, g, or t
  misc_feature (1019)..(1019): n is a, c, g, or t
  misc_feature (1030)..(1030): n is a, c, g, or t
  misc_feature (1036)..(1038): n is a, c, g, or t
  misc_feature (1043)..(1043): n is a, c, g, or t
  misc_feature (1049)..(1049): n is a, c, g, or t
  misc_feature (1052)..(1052): n is a, c, g, or t
  misc_feature (1059)..(1059): n is a, c, g, or t
  misc_feature (1082)..(1082): n is a, c, g, or t
  misc_feature (1096)..(1096): n is a, c, g, or t
  misc_feature (1100)..(1101): n is a, c, g, or t
  misc_feature (1103)..(1103): n is a, c, g, or t
  misc_feature (1123)..(1123): n is a, c, g, or t
  misc_feature (1147)..(1147): n is a, c, g, or t
  misc_feature (1149)..(1149): n is a, c, g, or t
  misc_feature (1167)..(1168): n is a, c, g, or t
  misc_feature (1172)..(1172): n is a, c, g, or t
  misc_feature (1176)..(1176): n is a, c, g, or t
  misc_feature (1182)..(1182): n is a, c, g, or t
  misc_feature (1187)..(1187): n is a, c, g, or t
  misc_feature (1193)..(1193): n is a, c, g, or t
  misc_feature (1200)..(1200): n is a, c, g, or t
  misc_feature (1223)..(1223): n is a, c, g, or t
  misc_feature (1225)..(1225): n is a, c, g, or t
  misc_feature (1228)..(1228): n is a, c, g, or t
  misc_feature (1231)..(1231): n is a, c, g, or t
  misc_feature (1233)..(1233): n is a, c, g, or t
  misc_feature (1237)..(1237): n is a, c, g, or t
  misc_feature (1260)..(1261): n is a, c, g, or t
  misc_feature (1265)..(1265): n is a, c, g, or t
  misc_feature (1282)..(1282): n is a, c, g, or t
  misc_feature (1289)..(1289): n is a, c, g, or t
  misc_feature (1302)..(1302): n is a, c, g, or t
naantagagaaattactatgagaggatcgcatcaccatcaccatcacggatcctatttaggtgacactatagaatcgtcgacccacgcgtccgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaaggagaacattgtcaattcttttactgataaacaacaaacacccagaaaaattacctataccaatggatagcnaaaaaaccttatgtgtgaactcnatgaaaactgggnaaanaatagtaagagggactacttnaagttctagttttcnaatgttcngaagaagaaanagcttnnnaaaanaatttntangaactcngattcctccttttccgggaattnctaaaaagggaaantccnntnaaaaagtcccccccttaaanttcaaaaaaaaactttaaaaaatncncctttttgaaaaacaaanntggnaaancccttnttggnaccccnaatgccnaaaaaaaccccccccaaaggggncnaanccngncttnaaaaaaaaaccaaaaaaggtggnncccnttggggggggggaaacnttacccnaaaaaaggggggn

SEQ ID NO: 41 - DNA, 1087 bp, Homo sapiens
  misc_feature (880)..(880): n is a, c, g, or t
  misc_feature (909)..(909): n is a, c, g, or t
  misc_feature (920)..(920): n is a, c, g, or t
  misc_feature (948)..(948): n is a, c, g, or t
  misc_feature (967)..(967): n is a, c, g, or t
  misc_feature (982)..(982): n is a, c, g, or t
  misc_feature (990)..(990): n is a, c, g, or t
  misc_feature (997)..(998): n is a, c, g, or t
  misc_feature (1018)..(1018): n is a, c, g, or t
  misc_feature (1023)..(1023): n is a, c, g, or t
  misc_feature (1025)..(1025): n is a, c, g, or t
  misc_feature (1036)..(1036): n is a, c, g, or t
  misc_feature (1044)..(1044): n is a, c, g, or t
  misc_feature (1047)..(1047): n is a, c, g, or t
  misc_feature (1050)..(1050): n is a, c, g, or t
  misc_feature (1053)..(1053): n is a, c, g, or t
  misc_feature (1059)..(1059): n is a, c, g, or t
  misc_feature (1064)..(1065): n is a, c, g, or t
  misc_feature (1067)..(1067): n is a, c, g, or t
  misc_feature (1070)..(1070): n is a, c, g, or t
  misc_feature (1073)..(1073): n is a, c, g, or t
  misc_feature (1075)..(1076): n is a, c, g, or t
  misc_feature (1080)..(1080): n is a, c, g, or t
tagagaaattactatgagaggatcgcatcaccatcaccatcacggatcctatttaggtgacactatagaatcgtcgacccacgcgtccgagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacganttggtgaatgcaacttcaatgtggaggangccctgcgaangctgcggttcacgtgaaggtgatccganatgggctctgtgcttggantgaaaaagaatgcangaactttnaacacgnntccgtgtgcatggaaaaaantttcncntgatccaggcnaacaaggngcnccnacnggtcantgggnnantgnttnannactntacctgt

SEQ ID NO: 42 - DNA, 2269 bp, Homo sapiens
atgctgcgtgcaaaaaatcagctgtttctgctgtctccgcattatctgcgtcaggttaaagaaagcagcggtagccgtctgattcagcagcgtctgctgcaccaacaacagccactgcatccggaatgggcagcactggcaaaaaaacagctgaaaggcaaaaatccggaagatctgatttggcatacaccggaaggtattagcattaaaccgctgtatagcaaacgtgataccatggatctgccggaagaactgcctggtgttaaaccgtttacccgtggtccgtatccgaccatgtatacctttcgtccgtggaccattcgtcagtatgcaggttttagcaccgtggaagagagcaacaaattctataaagataacattaaagcaggtcagcagggtctgagcgttgcatttgatctggcaacccatcgtggttatgatagcgataatccgcgtgttcgtggtgatgttggtatggcaggcgttgcaattgataccgtggaagataccaaaattctgtttgatggcatcccgctggaaaaaatgagcgttagcatgaccatgaatggtgcagttattccggttctggccaattttattgttaccggtgaagaacagggtgttccgaaagaaaaactgaccggcaccattcagaatgatattctgaaagaatttatggtgcgcaacacctatatttttccgcctgaaccgagcatgaaaattatcgccgatatcttcgaatataccgccaaacatatgccgaaattcaacagcattagcatcagcggttatcatatgcaggaagcaggcgcagacgcaattctggaactggcatataccctggcagatggtctggaatatagccgtaccggtctgcaggcaggtctgaccattgatgaatttgcaccgcgtctgagctttttttggggcatcggcatgaacttttacatggaaattgcaaaaatgcgtgcaggtcgtcgtctgtgggcacatctgatcgaaaaaatgttccagccgaaaaatagcaaaagcctgctgctgcgtgctcattgtcagaccagcggttggagcctgaccgaacaggacccgtataataacattgtgcgtaccgcaattgaagcaatggcagcagtttttggtggcacccagagcctgcataccaatagctttgatgaagcactgggtctgccgaccgttaaaagcgcacgtattgcacgtaacacccagattattattcaggaagaaagcggtattccgaaagttgcagatccgtggggtggtagctatatgatggaatgcctgaccaatgatgtttatgatgcagccctgaaactgattaacgaaatcgaagaaatgggtggtatggcaaaagcagttgcagaaggcattccgaaactgcgtattgaagaatgtgcagcacgtcgtcaggcacgtattgatagcggtagcgaagttattgtgggcgtgaacaaatatcagctggaaaaagaagatgcagttgaagttctggcaattgataataccagcgtgcgtaatcgccagatcgagaaactgaaaaaaatcaaaagcagccgtgatcaggcactggcagaacattgtctggcagcactgaccgaatgtgcagccagcggtgatggtaatattctggcactggcagttgatgcaagccgtgcacgttgtaccgttggtgaaattaccgatgccctgaaaaaagtgtttggcgaacacaaagccaatgatcgtatggttagcggtgcatatcgtcaggaatttggcgaaagcaaagaaattaccagcgccattaaacgcgtgcataaatttatggaacgtgaaggtcgccgtccgcgtctgctggttgcaaaaatgggtcaggatggtcatgatcgtggtgcaaaagttattgcaaccggttttgcagatctgggttttgatgttgatattggtccgctgtttcagacaccgcgtgaagttgcacagcaggccgttgatgcagatgttcatgcagttggtgttagcaccctggcagcaggtcataaaaccctggttccggaactgattaaagaactgaatagcctgggtcgtccggatattctggttatgtgtggtggtgttattccgcctcaggattatgaatttctgtttgaagtgggcgttagcaatgtttttggtccgggtacacgcattccgaaagcagcagttcaggttctggatgatatcgagaaatgcctggaaaaaaaacaacagagcgtgtaagcggccgcttaattaa

SEQ ID NO: 43 - DNA, 960 bp, Homo sapiens
gagaggtcgcatcaccatcaccatcacggatcctatttaggtgacactatagaatcgtcgacccacgcgtccgagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaagt

SEQ ID NO: 44 - DNA, 960 bp, Homo sapiens; identical to SEQ ID NO: 43

SEQ ID NO: 45 - DNA, 1226 bp, Homo sapiens
  misc_feature (849)..(849): n is a, c, g, or t
  misc_feature (885)..(885): n is a, c, g, or t
  misc_feature (900)..(900): n is a, c, g, or t
  misc_feature (912)..(912): n is a, c, g, or t
  misc_feature (953)..(953): n is a, c, g, or t
  misc_feature (963)..(963): n is a, c, g, or t
  misc_feature (1001)..(1002): n is a, c, g, or t
  misc_feature (1030)..(1030): n is a, c, g, or t
  misc_feature (1036)..(1036): n is a, c, g, or t
  misc_feature (1049)..(1049): n is a, c, g, or t
  misc_feature (1051)..(1051): n is a, c, g, or t
  misc_feature (1070)..(1070): n is a, c, g, or t
  misc_feature (1083)..(1083): n is a, c, g, or t
  misc_feature (1096)..(1096): n is a, c, g, or t
  misc_feature (1100)..(1101): n is a, c, g, or t
  misc_feature (1107)..(1107): n is a, c, g, or t
  misc_feature (1109)..(1109): n is a, c, g, or t
  misc_feature (1114)..(1114): n is a, c, g, or t
  misc_feature (1120)..(1120): n is a, c, g, or t
  misc_feature (1128)..(1128): n is a, c, g, or t
  misc_feature (1130)..(1130): n is a, c, g, or t
  misc_feature (1134)..(1134): n is a, c, g, or t
  misc_feature (1146)..(1146): n is a, c, g, or t
  misc_feature (1154)..(1155): n is a, c, g, or t
  misc_feature (1158)..(1158): n is a, c, g, or t
  misc_feature (1160)..(1160): n is a, c, g, or t
  misc_feature (1168)..(1168): n is a, c, g, or t
  misc_feature (1170)..(1170): n is a, c, g, or t
  misc_feature (1172)..(1172): n is a, c, g, or t
  misc_feature (1181)..(1181): n is a, c, g, or t
  misc_feature (1184)..(1184): n is a, c, g, or t
  misc_feature (1188)..(1188): n is a, c, g, or t
aatagagaaattactatgagaggatcgcatcaccatcaccatcacggatcctatttaggtgacactatagaatcgtcgacccacgcgtccggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcanaagctgccgctgtggcaacaggcctgtgccgacccnagcaagatcccggancgcgcggtgcanctcatgcagcaggtggccagcaacggcgccacccttccccnagcgccctgntcggcccccaagtccaacctgggtcatttccgaccccnnttccggggggccaagcccctgccggggncccccnaagctggcaccgntncgtggggggggatttctgncccagaaaaaccnacccatcatgaancggnntccaangncccgnatgggnagaaaaanancccntggggctgaccncaagggtnnccnanccaaaatncntntttcccccngantttnaaaaaaagtttagggaatcttatttcaaaaaaattccc

SEQ ID NO: 46 - DNA, 1179 bp, Homo sapiens
  misc_feature (859)..(859): n is a, c, g, or t
  misc_feature (897)..(898): n is a, c, g, or t
  misc_feature (906)..(906): n is a, c, g, or t
  misc_feature (945)..(945): n is a, c, g, or t
  misc_feature (954)..(954): n is a, c, g, or t
  misc_feature (979)..(979): n is a, c, g, or t
  misc_feature (981)..(981): n is a, c, g, or t
  misc_feature (993)..(993): n is a, c, g, or t
  misc_feature (1005)..(1005): n is a, c, g, or t
  misc_feature (1018)..(1018): n is a, c, g, or t
  misc_feature (1020)..(1022): n is a, c, g, or t
  misc_feature (1027)..(1027): n is a, c, g, or t
  misc_feature (1031)..(1031): n is a, c, g, or t
  misc_feature (1036)..(1036): n is a, c, g, or t
  misc_feature (1038)..(1038): n is a, c, g, or t
  misc_feature (1043)..(1043): n is a, c, g, or t
  misc_feature (1052)..(1052): n is a, c, g, or t
  misc_feature (1058)..(1058): n is a, c, g, or t
  misc_feature (1077)..(1077): n is a, c, g, or t
  misc_feature (1096)..(1096): n is a, c, g, or t
  misc_feature (1108)..(1108): n is a, c, g, or t
  misc_feature (1110)..(1110): n is a, c, g, or t
  misc_feature (1136)..(1136): n is a, c, g, or t
  misc_feature (1142)..(1142): n is a, c, g, or t
  misc_feature (1144)..(1144): n is a, c, g, or t
  misc_feature (1150)..(1150): n is a, c, g, or t
  misc_feature (1157)..(1157): n is a, c, g, or t
  misc_feature (1168)..(1168): n is a, c, g, or t
  misc_feature (1175)..(1175): n is a, c, g, or t
  misc_feature (1177)..(1178): n is a, c, g, or t
tagagaaattactatgagaggatcgcatcaccatcaccatcacggatcctatttaggtgacactatagaatcgtcgacccacgcgtccggccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcnagtatagaaaaaggtggttctccttccccaaagtggannccaattcntcaattatgtgaagaattgcttccggatgactgaccaanaggctatcnagatctctggcagtggaggaagtcncnttaaaaaaatantttaaacaattngttaaaaaatttncnnncttanttcntttcngnaacanttgaaatcnggctgncctttttaaaaggcaaaangaaaactttccccaccggnttgaaaaatgtngnccaggtctattgccaaaaatggttgnccaaangnccgttnatttttnaaaaaggaacnccccccntnnc

SEQ ID NO: 47 - DNA, 856 bp, Homo sapiens
  misc_feature (786)..(786): n is a, c, g, or t
  misc_feature (804)..(804): n is a, c, g, or t
  misc_feature (816)..(816): n is a, c, g, or t
  misc_feature (822)..(822): n is a, c, g, or t
  misc_feature (829)..(829): n is a, c, g, or t
  misc_feature (848)..(848): n is a, c, g, or t
  misc_feature (851)..(851): n is a, c, g, or t
taagaggagaattaactatgagaggatcgcatcaccatcaccatcacggatcctatttaggtgacactatagaatcgtcgacccacgcgtccgatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatggcggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccatttgtctatgaattggacaagaacttgaancctatcaagcccatgcanttttctgggggnatgaanagacggngcccaaagccatggaaagntgnggctg

SEQ ID NO: 48 - DNA, 1371 bp, Homo sapiens
gcccgcctaagaaacaattgagaggatgcatcaccatcaccatcacggtcgacccacgcgtccgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccaaagtggatctctcgacaccagtaccatgcactcccggccactgtctggtcactgggcatcctcctctatgacatggagtgtggggaaattcccttttgaaagggaacaagaaaatcctggaaactgaaactccacttcccaacccaggtctccccaaaatgctgtgccctaatccaccggtgcctggcccccaacccttctccccaacctacctggaaaaaacccgctgaacccctaaaagacaacccactcagaaattacccctcatcccctcaagaggcacttcccccttcgccctctccatcacacttaaccataaagaacgctcgactgccatccactacacaacactcctaccagccaaacccctcatacatgcaatataccactctcaatcactactccatcaaacttcacaacaccactcaacaaaccccctcccattacacgatacacaatatacatatcacaaccaacctcacacgctacataacattcctaccaacccacattcacat

SEQ ID NO: 49 - DNA, 1178 bp, Homo sapiens
  misc_feature (1)..(1): n is a, c, g, or t
  misc_feature (781)..(781): n is a, c, g, or t
  misc_feature (870)..(870): n is a, c, g, or t
  misc_feature (888)..(888): n is a, c, g, or t
  misc_feature (894)..(894): n is a, c, g, or t
  misc_feature (924)..(924): n is a, c, g, or t
  misc_feature (978)..(978): n is a, c, g, or t
  misc_feature (984)..(984): n is a, c, g, or t
  misc_feature (996)..(996): n is a, c, g, or t
  misc_feature (1007)..(1007): n is a, c, g, or t
  misc_feature (1014)..(1014): n is a, c, g, or t
  misc_feature (1020)..(1020): n is a, c, g, or t
  misc_feature (1028)..(1028): n is a, c, g, or t
  misc_feature (1034)..(1035): n is a, c, g, or t
  misc_feature (1041)..(1041): n is a, c, g, or t
  misc_feature (1045)..(1045): n is a, c, g, or t
  misc_feature (1053)..(1053): n is a, c, g, or t
  misc_feature (1060)..(1060): n is a, c, g, or t
  misc_feature (1063)..(1063): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1083)..(1083): n is a, c, g, or t
  misc_feature (1101)..(1101): n is a, c, g, or t
  misc_feature (1106)..(1106): n is a, c, g, or t
  misc_feature (1110)..(1110): n is a, c, g, or t
  misc_feature (1121)..(1121): n is a, c, g, or t
  misc_feature (1126)..(1127): n is a, c, g, or t
  misc_feature (1131)..(1131): n is a, c, g, or t
  misc_feature (1146)..(1146): n is a, c, g, or t
  misc_feature (1154)..(1154): n is a, c, g, or t
  misc_feature (1157)..(1157): n is a, c, g, or t
  misc_feature (1160)..(1161): n is a, c, g, or t
  misc_feature (1168)..(1168): n is a, c, g, or t
naattagagaaattactatgaagaggatcgcatcaccatcaccatcacggatcctatttaggtgacactatagaatcgtcgacccacgcgtccgggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcanaagacatatttacagttttgacagctgaagaaaagcagcgattggaagagctccagctgttcaaaaataaggaaaccagtgttgccatngaggttatcgaggacccnaaaaanaaaagaaccatcatccatcaggctatcaantctctgtttccggattaaagacaaaaaccgaggataggggaggggagaaatacnttgtancctaccccccanctgggaaaaangctttgncaatangggtctgngaacanntcctcntgcnagcaaccntgagggnagncccctcntnttancttgccnttcggttcaaggctactnaaggntgcncaaaaaaattnatctnncccncctcaaaagggaaantgtccttnaangcnngcaattntgacctgctg

SEQ ID NO: 50 - DNA, 1191 bp, Homo sapiens
  misc_feature (1)..(1): n is a, c, g, or t
  misc_feature (3)..(3): n is a, c, g, or t
  misc_feature (784)..(784): n is a, c, g, or t
  misc_feature (847)..(847): n is a, c, g, or t
  misc_feature (919)..(919): n is a, c, g, or t
  misc_feature (934)..(934): n is a, c, g, or t
  misc_feature (955)..(955): n is a, c, g, or t
  misc_feature (966)..(966): n is a, c, g, or t
  misc_feature (978)..(978): n is a, c, g, or t
  misc_feature (1016)..(1016): n is a, c, g, or t
  misc_feature (1028)..(1028): n is a, c, g, or t
  misc_feature (1033)..(1033): n is a, c, g, or t
  misc_feature (1040)..(1040): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1097)..(1097): n is a, c, g, or t
  misc_feature (1101)..(1101): n is a, c, g, or t
  misc_feature (1106)..(1106): n is a, c, g, or t
  misc_feature (1108)..(1108): n is a, c, g, or t
  misc_feature (1112)..(1112): n is a, c, g, or t
  misc_feature (1136)..(1136): n is a, c, g, or t
  misc_feature (1144)..(1144): n is a, c, g, or t
  misc_feature (1156)..(1156): n is a, c, g, or t
  misc_feature (1170)..(1170): n is a, c, g, or t
nantagagaaattactatgagaggatcgcatcaccatcaccatcacggatcctatttaggtgacactatagaatcgtcgacccacgcgtccgccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgaggagaagaaagacgacgagaacattccgatggagacagaggagacacaccttgaagaaacaacagagagccaacagaatgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaanttcttagtgagagtgtggtgccagacgttcggtcagttgtcacaacagctagaatgcaggtcntcaaacggcaggtccagtccttaatggttcatcagcgaaaaactagaagctgaacttcttcaaatagaggancgacccccggaaaanaagagaaattcctggaaagcncagattctttnacaatgaacttnaaaggttgggcggtctgaaagtaaaagtggatttgganaaaattgcaccnaaatngcccagncanagnaacggncccccaaaggcaggaggaaagggaaaaagaggccccaaacaagtngacncattnanacanctctttctgaggaaaaaaaccccntacaaggngaggaaaaaaanacaccaaactttcnatggaacaaggggtccacatt

SEQ ID NO: 51 - DNA, 1179 bp, Homo sapiens
  misc_feature (14)..(14): n is a, c, g, or t
  misc_feature (916)..(916): n is a, c, g, or t
  misc_feature (921)..(921): n is a, c, g, or t
  misc_feature (952)..(952): n is a, c, g, or t
  misc_feature (957)..(957): n is a, c, g, or t
  misc_feature (967)..(967): n is a, c, g, or t
  misc_feature (984)..(984): n is a, c, g, or t
  misc_feature (997)..(997): n is a, c, g, or t
  misc_feature (1013)..(1013): n is a, c, g, or t
  misc_feature (1024)..(1024): n is a, c, g, or t
  misc_feature (1037)..(1037): n is a, c, g, or t
  misc_feature (1043)..(1043): n is a, c, g, or t
  misc_feature (1061)..(1061): n is a, c, g, or t
  misc_feature (1078)..(1078): n is a, c, g, or t
  misc_feature (1091)..(1091): n is a, c, g, or t
  misc_feature (1097)..(1097): n is a, c, g, or t
  misc_feature (1101)..(1101): n is a, c, g, or t
  misc_feature (1106)..(1106): n is a, c, g, or t
  misc_feature (1120)..(1120): n is a, c, g, or t
  misc_feature (1125)..(1125): n is a, c, g, or t
  misc_feature (1127)..(1127): n is a, c, g, or t
  misc_feature (1131)..(1131): n is a, c, g, or t
  misc_feature (1136)..(1136): n is a, c, g, or t
  misc_feature (1142)..(1142): n is a, c, g, or t
  misc_feature (1157)..(1157): n is a, c, g, or t
  misc_feature (1160)..(1160): n is a, c, g, or t
  misc_feature (1168)..(1168): n is a, c, g, or t
  misc_feature (1174)..(1174): n is a, c, g, or t
  misc_feature (1177)..(1177): n is a, c, g, or t
atagagaaattacnatgagaggatcgcatcaccatcaccattcacggatcctatttaggtgacactatagaatcgtcgacccacgcgtccgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggccctgggtcanatggntcccatgggtggattaggaggaatggagtcncatcncatgaatggnctctttaggctcagaanatatggacagtanttccaaaaattctccnataaaatgaancctgaataatcanccgggncctccaagggatgatggncaaaatgggggggaaantttcttaaattcnttttcnaagngaaanttactcccctaacntgganangagnggggngatccnttaccaagtcccccnagnaaaacccnagggantcncc

SEQ ID NO: 52 - DNA, 1337 bp, Homo sapiens
  misc_feature (919)..(919): n is a, c, g, or t
  misc_feature (924)..(924): n is a, c, g, or t
  misc_feature (941)..(941): n is a, c, g, or t
  misc_feature (958)..(958): n is a, c, g, or t
  misc_feature (960)..(960): n is a, c, g, or t
  misc_feature (968)..(968): n is a, c, g, or t
  misc_feature (985)..(985): n is a, c, g, or t
  misc_feature (1011)..(1011): n is a, c, g, or t
  misc_feature (1021)..(1021): n is a, c, g, or t
  misc_feature (1026)..(1026): n is a, c, g, or t
  misc_feature (1031)..(1032): n is a, c, g, or t
  misc_feature (1034)..(1034): n is a, c, g, or t
  misc_feature (1041)..(1041): n is a, c, g, or t
  misc_feature (1047)..(1047): n is a, c, g, or t
  misc_feature (1052)..(1052): n is a, c, g, or t
  misc_feature (1063)..(1063): n is a, c, g, or t
  misc_feature (1065)..(1065): n is a, c, g, or t
  misc_feature (1070)..(1070): n is a, c, g, or t
  misc_feature (1075)..(1075): n is a, c, g, or t
  misc_feature (1080)..(1080): n is a, c, g, or t
  misc_feature (1097)..(1097): n is a, c, g, or t
  misc_feature (1112)..(1112): n is a, c, g, or t
  misc_feature (1144)..(1144): n is a, c, g, or t
  misc_feature (1148)..(1148): n is a, c, g, or t
  misc_feature (1151)..(1151): n is a, c, g, or t
  misc_feature (1158)..(1158): n is a, c, g, or t
  misc_feature (1161)..(1161): n is a, c, g, or t
  misc_feature (1172)..(1172): n is a, c, g, or t
  misc_feature (1178)..(1178): n is a, c, g, or t
  misc_feature (1186)..(1187): n is a, c, g, or t
  misc_feature (1189)..(1189): n is a, c, g, or t
  misc_feature (1219)..(1219): n is a, c, g, or t
  misc_feature (1231)..(1231): n is a, c, g, or t
  misc_feature (1238)..(1239): n is a, c, g, or t
  misc_feature (1242)..(1242): n is a, c, g, or t
  misc_feature (1245)..(1245): n is a, c, g, or t
  misc_feature (1256)..(1256): n is a, c, g, or t
  misc_feature (1260)..(1260): n is a, c, g, or t
  misc_feature (1262)..(1262): n is a, c, g, or t
  misc_feature (1268)..(1268): n is a, c, g, or t
  misc_feature (1276)..(1276): n is a, c, g, or t
  misc_feature (1280)..(1280): n is a, c, g, or t
  misc_feature (1287)..(1287): n is a, c, g, or t
  misc_feature (1300)..(1300): n is a, c, g, or t
  misc_feature (1303)..(1303): n is a, c, g, or t
  misc_feature (1310)..(1310): n is a, c, g, or t
  misc_feature (1317)..(1317): n is a, c, g, or t
  misc_feature (1323)..(1324): n is a, c, g, or t
  misc_feature (1333)..(1334): n is a, c, g, or t
tagagaaattactatgagaggatcgcatcaccatcaccatcacggatcctatttaggtgacactatagaatcgtcgacccacgcgtccgggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaaggtcgccgcttccacggctcaactgctggtggcctgcaaggtgaaaggccgaccaggattcagaggccnatgangcggctacaggcggcangaaatgctgtgaaaaanancctcaaanaatcttgtccgtgccancccaaaaaggcagctttttggcaaanctgaatgacnaccanttttnnantggaaancccaanttttnggggggggcantngcttnaaatnattcnccccccaaaaaaaaatngttaaaaaaaaaccnaaaaattggaaaaaaccaaggaaaaaactggncccnaantcccccnacnacaatataaantttttnccccccanntnaaggaaaataaaggctaaaggtccaacccnaatgggaccccnggggatnnccntgnttaaatggaanaaantnttcttnaaaagtgnggcncttactngaaaccccccccnccncccgggnaaaccgnaacccnngggtttttnncca

SEQ ID NO: 53 - DNA, 1268 bp, Homo sapiens
  misc_feature (1)..(1): n is a, c, g, or t
  misc_feature (705)..(705): n is a, c, g, or t
  misc_feature (1243)..(1243): n is a, c, g, or t
  misc_feature (1261)..(1261): n is a, c, g, or t
ngggatatactgacttacctataaaaaggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgcggggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctgnacgacagtggctacgtgagcgcctacaagaatgcaggcacctacgatgccaagggtgagaagtgaggcttgggaagaccgccctgccaagtgcggctgcccctgccagaggctcaggcctgggtctaaggggcacgggaagcaagaaatcctggtcccctccccggtggacctgcccccaaaacctcctgcctaacccactgggctggcccacaggccccttgaccaggttgctcgggggcccttcccccctcccttcccggtccaattttgggcccccgggggaaaactgggccagaagcccccaaacccccggacgccaaatccaggcgaacaccaataagcggaccggaaccccgaacgaaaaaccgcaaaaggcccaaaacactgaccggagggagtcaaagaacagggagccgcagggcgacacagcgatgacaacagccaacatgcgaccggattccgcacacggagccagggatagaaacaaaaaaccgcgataccgccgacgaagatacgaaaggacaccccccagcagnaagagacagaaggacggnacaaaac

SEQ ID NO: 54 - DNA, 1241 bp, Homo sapiens
  misc_feature (930)..(930): n is a, c, g, or t
  misc_feature (1007)..(1007): n is a, c, g, or t
  misc_feature (1038)..(1038): n is a, c, g, or t
  misc_feature (1040)..(1040): n is a, c, g, or t
  misc_feature (1043)..(1043): n is a, c, g, or t
  misc_feature (1050)..(1050): n is a, c, g, or t
  misc_feature (1067)..(1067): n is a, c, g, or t
  misc_feature (1095)..(1095): n is a, c, g, or t
  misc_feature (1097)..(1097): n is a, c, g, or t
  misc_feature (1107)..(1107): n is a, c, g, or t
  misc_feature (1126)..(1126): n is a, c, g, or t
  misc_feature (1150)..(1150): n is a, c, g, or t
  misc_feature (1160)..(1160): n is a, c, g, or t
  misc_feature (1166)..(1166): n is a, c, g, or t
  misc_feature (1168)..(1168): n is a, c, g, or t
  misc_feature (1171)..(1171): n is a, c, g, or t
  misc_feature (1173)..(1174): n is a, c, g, or t
  misc_feature (1178)..(1179): n is a, c, g, or t
  misc_feature (1185)..(1185): n is a, c, g, or t
  misc_feature (1188)..(1191): n is a, c, g, or t
  misc_feature (1193)..(1194): n is a, c, g, or t
  misc_feature (1200)..(1200): n is a, c, g, or t
  misc_feature (1210)..(1210): n is a, c, g, or t
  misc_feature (1215)..(1215): n is a, c, g, or t
  misc_feature (1219)..(1219): n is a, c, g, or t
  misc_feature (1223)..(1223): n is a, c, g, or t
  misc_feature (1234)..(1234): n is a, c, g, or t
  misc_feature (1236)..(1236): n is a, c, g, or t
tagaggaaattactatgagaggatcgcatcaccatcaccatcacggatcctatttaggtgacactatagaatcgtcgacccacgcgtccgcccacgcgtccgcggacgcgtgggttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaagcatcttatctaaaagaaaggctatccagtanagcccagtgctcccttgtccctcttttatgatcagggtgaaatgtacttcctgatgtatgaacctaatttgattccnttttaaggggggtctgtgcactgggtccccnantcngctgtcnttgtccggaaaaacccnttttttgaggctgacttcctgatctacncnccccgcccancaaagcccctctgaccaanaacctgttggtgggaacctgcccnaaatgatgangacggntnccncnngtgnncccccntannnnanntaaaangtgccccccntttcngatncccngggaaaaaacntntggtt

SEQ ID NO: 55 - DNA, 483 bp, Homo sapiens
  misc_feature (234)..(234): n is a, c, g, or t
  misc_feature (290)..(290): n is a, c, g, or t
  misc_feature (294)..(294): n is a, c, g, or t
  misc_feature (298)..(298): n is a, c, g, or t
  misc_feature (315)..(315): n is a, c, g, or t
  misc_feature (409)..(409): n is a, c, g, or t
  misc_feature (411)..(411): n is a, c, g, or t
  misc_feature (415)..(415): n is a, c, g, or t
  misc_feature (438)..(438): n is a, c, g, or t
  misc_feature (443)..(444): n is a, c, g, or t
  misc_feature (448)..(450): n is a, c, g, or t
  misc_feature (456)..(456): n is a, c, g, or t
  misc_feature (465)..(465): n is a, c, g, or t
  misc_feature (467)..(467): n is a, c, g, or t
  misc_feature (472)..(472): n is a, c, g, or t
  misc_feature (476)..(476): n is a, c, g, or t
  misc_feature (480)..(480): n is a, c, g, or t
tgaatagagagaattactatgagaggatcgcatcaccatcaccatcacgggatcctatttaggtgacactatagaatcgtcgacccacgcgtccgcggacgcgtgggggagcatcccctgtccctgtgtgagcaggtggcccccatcattgacctcatggccgtcagcaatgcgctttttgccaagctccgggacttcatcaccctgcgtctgcctcctggcttcccagttaanattgaaatcccgatcttccacatcctcaacgcccgcatcaccttcgggaacctcancggntgcnacgaaccggtgccatcngtgcgaggcagccccagcagcgagacgccttccccaggcagcgactcctccagcgtcagcagctccagctccacgacctcctgccgcggctgcnanatcnccccagcgttgttcgaggccccncgcgnntacnnncatgangggctggcnancgggnggcngtanacc

SEQ ID NO: 56 - DNA, 966 bp, Homo sapiens
catcaccatcaccatcacggatcctatttaggtgacactatagaatcgtcgacccacgcgtccgggctgacccagctccagctgctgacccaggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagt

SEQ ID NO: 57 - DNA, 881 bp, Homo sapiens
tgagaggatcgcatcaccatcaccatcacggatcctatttaggtgacactatagaatcgtcgacccacgcgtccgaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattc

SEQ ID NO: 58 - DNA, 1215 bp, Homo sapiens
  misc_feature (864)..(864): n is a, c, g, or t
  misc_feature (908)..(908): n is a, c, g, or t
  misc_feature (917)..(917): n is a, c, g, or t
  misc_feature (948)..(948): n is a, c, g, or t
  misc_feature (959)..(959): n is a, c, g, or t
  misc_feature (987)..(987): n is a, c, g, or t
  misc_feature (990)..(990): n is a, c, g, or t
  misc_feature (998)..(998): n is a, c, g, or t
  misc_feature (1005)..(1005): n is a, c, g, or t
  misc_feature (1036)..(1036): n is a, c, g, or t
  misc_feature (1048)..(1048): n is a, c, g, or t
  misc_feature (1060)..(1060): n is a, c, g, or t
  misc_feature (1063)..(1063): n is a, c, g, or t
  misc_feature (1066)..(1066): n is a, c, g, or t
  misc_feature (1070)..(1070): n is a, c, g, or t
  misc_feature (1085)..(1085): n is a, c, g, or t
  misc_feature (1091)..(1091): n is a, c, g, or t
  misc_feature (1093)..(1093): n is a, c, g, or t
  misc_feature (1099)..(1099): n is a, c, g, or t
  misc_feature (1102)..(1103): n is a, c, g, or t
  misc_feature (1119)..(1119): n is a, c, g, or t
  misc_feature (1125)..(1125): n is a, c, g, or t
  misc_feature (1132)..(1132): n is a, c, g, or t
  misc_feature (1140)..(1140): n is a, c, g, or t
  misc_feature (1145)..(1145): n is a, c, g, or t
  misc_feature (1151)..(1152): n is a, c, g, or t
  misc_feature (1155)..(1155): n is a, c, g, or t
  misc_feature (1163)..(1164): n is a, c, g, or t
  misc_feature (1167)..(1167): n is a, c, g, or t
  misc_feature (1181)..(1181): n is a, c, g, or t
  misc_feature (1184)..(1184): n is a, c, g, or t
  misc_feature (1187)..(1187): n is a, c, g, or t
  misc_feature (1190)..(1190): n is a, c, g, or t
  misc_feature (1194)..(1195): n is a, c, g, or t
  misc_feature (1201)..(1201): n is a, c, g, or t
gagaaattactatgagaggatcgcatcaccatcaccatcacggatcctatttaggtgacactatagaatcgtcgacccacgcgtccgcggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcanaaaatggagtgaccagtctgactgtggaacttatgggtgcacanaatcaaaangtttctgtgggaatttaaatataaaacttgnaaatgtatccnccactcaatcaaacgttatctcaagaantantgaacacncagctgnctttggaacgtcaaaaactgcaaaaaaaaancgattatttctngtatatgctaancanggngganaaatattgcaattcnacctcnanaactcngannggttaaaattttgccnggttgnaaattanttaaaaantttangccggnnttnaaatttannggnaggggggaaattcnttnaanttntttnnaaaggnttcccaaaaaaaaa

SEQ ID NO: 59 - DNA, 1150 bp, Homo sapiens
  misc_feature (1)..(1): n is a, c, g, or t
  misc_feature (846)..(846): n is a, c, g, or t
  misc_feature (884)..(884): n is a, c, g, or t
  misc_feature (928)..(928): n is a, c, g, or t
  misc_feature (930)..(930): n is a, c, g, or t
  misc_feature (953)..(953): n is a, c, g, or t
  misc_feature (958)..(958): n is a, c, g, or t
  misc_feature (963)..(964): n is a, c, g, or t
  misc_feature (975)..(975): n is a, c, g, or t
  misc_feature (981)..(981): n is a, c, g, or t
  misc_feature (987)..(987): n is a, c, g, or t
  misc_feature (1000)..(1000): n is a, c, g, or t
  misc_feature (1006)..(1006): n is a, c, g, or t
  misc_feature (1018)..(1018): n is a, c, g, or t
  misc_feature (1035)..(1035): n is a, c, g, or t
  misc_feature (1057)..(1057): n is a, c, g, or t
  misc_feature (1061)..(1061): n is a, c, g, or t
  misc_feature (1066)..(1066): n is a, c, g, or t
  misc_feature (1070)..(1070): n is a, c, g, or t
  misc_feature (1072)..(1072): n is a, c, g, or t
  misc_feature (1078)..(1078): n is a, c, g, or t
  misc_feature (1084)..(1084): n is a, c, g, or t
  misc_feature (1102)..(1103): n is a, c, g, or t
  misc_feature (1108)..(1108): n is a, c, g, or t
  misc_feature (1110)..(1110): n is a, c, g, or t
  misc_feature (1113)..(1113): n is a, c, g, or t
  misc_feature (1117)..(1117): n is a, c, g, or t
  misc_feature (1121)..(1121): n is a, c, g, or t
  misc_feature (1124)..(1124): n is a, c, g, or t
  misc_feature (1136)..(1137): n is a, c, g, or t
  misc_feature (1147)..(1147): n is a, c, g, or t
naatagagaaattactatgagaggatcgcatcaccatcaccatcacggatcctatttaggtgacactatagaatcgtcgacccacgcgtccgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactanacttttcttttttaaggaagtgctgttttttttttganggttttcaaaacattttgaaaagcatttactttttttgaccacnanccatgaatttttcaaaaaaatcnggggntgggnngggtttttggnttttgntttaanttttgggttgccnttgccntttttttttttnaggggggttggcccccntgaaagggggtgccccccctcncttnctctnaaantnaaacgnaattgnaaatccccccctttttcnnaaacntnaancaanctgnggntttttttccaanncccggggaanctt

SEQ ID NO: 60 - DNA, 856 bp, Homo sapiens
  misc_feature (581)..(581): n is a, c, g, or t
  misc_feature (706)..(706): n is a, c, g, or t
  misc_feature (734)..(734): n is a, c, g, or t
  misc_feature (746)..(746): n is a, c, g, or t
  misc_feature (802)..(802): n is a, c, g, or t
attacttgagaggtcgcatcaccatcccatcacggatcctatttaggtgacactatagaatcgtcgactctggaccttggctgtcactcagttaaagaagcagtagtgggtgccatgcacattcaggtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccangaggcagtggagggacgagtgcctcatgagactcgccaagttgaagagtcaagtgcagccccagtgaatttcttgtaatgcagcttccactcctctcattggaggccctatttggggacactgcnagccccttaatcaccctctgtgacatangtagcagccccngagaatctaagctggctgtcttgtgtgcaccctgaatggggtgtgcaagcccgtantctcccgtcacttggatcaaaccctgggctggcggcccacaccactgcgttccg

SEQ ID NO: 61 - DNA, 1268 bp, Homo sapiens
  misc_feature (128)..(128): n is a, c, g, or t
  misc_feature (911)..(911): n is a, c, g, or t
  misc_feature (954)..(954): n is a, c, g, or t
  misc_feature (978)..(978): n is a, c, g, or t
  misc_feature (983)..(983): n is a, c, g, or t
  misc_feature (989)..(989): n is a, c, g, or t
  misc_feature (1035)..(1035): n is a, c, g, or t
  misc_feature (1051)..(1051): n is a, c, g, or t
  misc_feature (1063)..(1063): n is a, c, g, or t
  misc_feature (1071)..(1071): n is a, c, g, or t
  misc_feature (1106)..(1106): n is a, c, g, or t
  misc_feature (1114)..(1114): n is a, c, g, or t
  misc_feature (1126)..(1126): n is a, c, g, or t
  misc_feature (1135)..(1135): n is a, c, g, or t
  misc_feature (1145)..(1145): n is a, c, g, or t
  misc_feature (1149)..(1149): n is a, c, g, or t
  misc_feature (1169)..(1169): n is a, c, g, or t
  misc_feature (1177)..(1177): n is a, c, g, or t
  misc_feature (1179)..(1179): n is a, c, g, or t
  misc_feature (1184)..(1184): n is a, c, g, or t
  misc_feature (1191)..(1191): n is a, c, g, or t
  misc_feature (1206)..(1206): n is a, c, g, or t
  misc_feature (1210)..(1210): n is a, c, g, or t
  misc_feature (1214)..(1214): n is a, c, g, or t
  misc_feature (1216)..(1216): n is a, c, g, or t
  misc_feature (1221)..(1221): n is a, c, g, or t
  misc_feature (1234)..(1234): n is a, c, g, or t
  misc_feature (1237)..(1237): n is a, c, g, or t
  misc_feature (1250)..(1250): n is a, c, g, or t
  misc_feature (1266)..(1266): n is a, c, g, or t
  misc_feature (1268)..(1268): n is a, c, g, or t
tagagaaattactatgagaggatcgcatcaccatcaccatcacggatcctatttaggtgacactatagaatcgtcgacccacgcgtccgcacagagctcagtgcaaccaccagaaggagacagtgaancaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttnaaccgaaaacttgctgatgaagttataactcgaaacgaactcntgctggaagaaactagaaacaccnttacngttccngcctctttcatgttgaggatgttggcttcccttaatcatatccganctgacggttggagggngacaaatcaaangctctggncacaaaatggaaatgaggatgaggataataactcntttggcancccttaatgtcngaatttgtnaaaaactttnttantttttttcttacaaactttnggcatttnanggtanggtttgnaattttccctttttngganaccnanattgnttggaaaatgggngcnaaatttgggaatnttaaaacaaactcccnan

SEQ ID NO: 62 - DNA, 803 bp, Homo sapiens
tgagaaattactatgagaggatcgcatcaccatcaccatcacggatcctatttaggtgacactatagaatcgtcgacccacgcgtccgggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatct

SEQ ID NO: 63 - DNA, 972 bp, Homo sapiens
  misc_feature (604)..(604): n is a, c, g, or t
  misc_feature (650)..(650): n is a, c, g, or t
  misc_feature (653)..(653): n is a, c, g, or t
  misc_feature (672)..(672): n is a, c, g, or t
  misc_feature (691)..(691): n is a, c, g, or t
  misc_feature (694)..(694): n is a, c, g, or t
  misc_feature (698)..(698): n is a, c, g, or t
  misc_feature (701)..(701): n is a, c, g, or t
  misc_feature (705)..(705): n is a, c, g, or t
  misc_feature (723)..(723): n is a, c, g, or t
  misc_feature (733)..(733): n is a, c, g, or t
  misc_feature (739)..(740): n is a, c, g, or t
  misc_feature (746)..(746): n is a, c, g, or t
  misc_feature (750)..(751): n is a, c, g, or t
  misc_feature (759)..(759): n is a, c, g, or t
  misc_feature (794)..(794): n is a, c, g, or t
  misc_feature (799)..(799): n is a, c, g, or t
  misc_feature (817)..(817): n is a, c, g, or t
  misc_feature (824)..(824): n is a, c, g, or t
  misc_feature (829)..(830): n is a, c, g, or t
  misc_feature (833)..(833): n is a, c, g, or t
  misc_feature (838)..(838): n is a, c, g, or t
  misc_feature (849)..(849): n is a, c, g, or t
  misc_feature (886)..(887): n is a, c, g, or t
  misc_feature (891)..(891): n is a, c, g, or t
  misc_feature (913)..(913): n is a, c, g, or t
  misc_feature (922)..(922): n is a, c, g, or t
  misc_feature (930)..(930): n is a, c, g, or t
  misc_feature (936)..(936): n is a, c, g, or t
  misc_feature (946)..(946): n is a, c, g, or t
  misc_feature (961)..(961): n is a, c, g, or t
  misc_feature (969)..(969): n is a, c, g, or t
  misc_feature (971)..(971): n is a, c, g, or t
tagagaaattactatgagaggatcgcatcaccatcaccatcacggatcctatttaggtgacactatagaatcgtcgacccacgcgtccgcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagttgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctgnatcccgccctcctcccccaccaccttccaccacctccaccgcccanagnccaagtggcccccaggatnacagcatgggggcgcccancanaaanccntggnggccatggacggccaaanattaaactgnacgccnnctggcnctgnntggaaatngggtgcacccctaggtttgtggggaacacagtaanggtcnatgggaggggggaacccngggaagngctannggnttttnccaaaaatccnctggaaaaaattttttaaaaaaaatttttgtggggtnngggnaaaaaaaaaaattttccttganccaattggnttcttttnaaaaanttttttaggnaaatttttttccttntttttttnana

SEQ ID NO: 64 - DNA, 1426 bp, Homo sapiens
  misc_feature (1)..(2): n is a, c, g, or t
  misc_feature (13)..(14): n is a, c, g, or t
  misc_feature (735)..(735): n is a, c, g, or t
  misc_feature (757)..(757): n is a, c, g, or t
  misc_feature (777)..(777): n is a, c, g, or t
  misc_feature (829)..(829): n is a, c, g, or t
nnggctaatctcnncctaagaatactatagaggatcgcatcaccatcaccatcacggtcgacccacgcgtccgcgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttggcacgcaaaaccacagcgccctggtaaccgagancacggtcgtcccctttcttccnggtcatcctgagtactcatncacacgaaatcagggcagacagaaagtagctcggttcaacgcccatgagttngccacgctggtcattgacattctcagtgacgccagaagagacggcaaggcagtcccctctccgggtcaaagaacatgtggagctcatactgaaaaccatcattaccagcccggcgttaaagtcaagacaacgatcacccgactatgacggcgggcattaaacgagacccagaattgggaacccttgaaacaaaacaaccggaaaaattggtttggaaaatggctattttgggaaggggcaccccctttgggggattttcccaaaaggggccttcaaaaaaaaattgaaagccccccaaaaaaaaaaaagggggccccgccccctgggccccaaaataggtgggacccccgggaaaaccccaaaaccccaacccccggtgtttttacaacccccggcccgcggggtttttttttgaaaaccccctctcggggatattgccgggaagaataaggagaaaaacctgtacccccgtttatcccgcgggaaaaaaatgtgttttcctctgcacaaaacccaccggtgttttcttcttaaaaaaaaaaaaattcctctttcctccccccgcgcccctaaaaaaaagaggggggggcctccccc

SEQ ID NO: 65 - DNA, 929 bp, Homo sapiens
catcaccatcaccatcacggatcctatttaggtgacactatagaatcgtcgacccacgcgtccgagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcattt

SEQ ID NO: 66 - DNA, 882 bp, Homo sapiens
acagggagatactatgagaggtcgcatcaccatcaccatcacggatcctatttaggtgacactatagaatcgtcgactctggaccttggctgtcactcagttaagaagacgacgcccatagaagctgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagctagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggccttcaggtggaggaagagccagtgtacgaagcagagcctgatcctgagcctgagcctgagcccgagcctgagcccgagcctgagaatgactatgaggacgttgaggagatggacaggcatgatcaggaggatgaaccacagggggactatgaggaggtgctcgagcctcgagattcttcattttcttctgctctggatggatcatcatgctgcccggctggagctggagctggggctgtggctctggggatctcagctgtggctctatatgattacccacgaaatgtaagtgatgagctttcctttgatccggacgacgtatcactgacattgacatggtcgacaacggctggtggcgggaacttgcccatgccacattggactctccctgca

SEQ ID NO: 67 - DNA, 1179 bp, Homo sapiens
  misc_feature (1)..(1): n is a, c, g, or t
  misc_feature (4)..(4): n is a, c, g, or t
  misc_feature (829)..(829): n is a, c, g, or t
  misc_feature (850)..(850): n is a, c, g, or t
  misc_feature (863)..(863): n is a, c, g, or t
  misc_feature (900)..(900): n is a, c, g, or t
  misc_feature (932)..(932): n is a, c, g, or t
  misc_feature (935)..(935): n is a, c, g, or t
  misc_feature (947)..(947): n is a, c, g, or t
  misc_feature (962)..(962): n is a, c, g, or t
  misc_feature (967)..(967): n is a, c, g, or t
  misc_feature (989)..(989): n is a, c, g, or t
  misc_feature (992)..(992): n is a, c, g, or t
  misc_feature (999)..(999): n is a, c, g, or t
  misc_feature (1001)..(1001): n is a, c, g, or t
  misc_feature (1004)..(1004): n is a, c, g, or t
  misc_feature (1011)..(1011): n is a, c, g, or t
  misc_feature (1013)..(1013): n is a, c, g, or t
  misc_feature (1024)..(1024): n is a, c, g, or t
  misc_feature (1029)..(1029): n is a, c, g, or t
  misc_feature (1039)..(1039): n is a, c, g, or t
  misc_feature (1045)..(1045): n is a, c, g, or t
  misc_feature (1049)..(1049): n is a, c, g, or t
  misc_feature (1063)..(1063): n is a, c, g, or t
  misc_feature (1068)..(1068): n is a, c, g, or t
  misc_feature (1074)..(1074): n is a, c, g, or t
  misc_feature (1089)..(1089): n is a, c, g, or t
  misc_feature (1091)..(1091): n is a, c, g, or t
  misc_feature (1100)..(1100): n is a, c, g, or t
  misc_feature (1107)..(1107): n is a, c, g, or t
  misc_feature (1115)..(1116): n is a, c, g, or t
  misc_feature (1123)..(1123): n is a, c, g, or t
  misc_feature (1126)..(1126): n is a, c, g, or t
  misc_feature (1130)..(1130): n is a, c, g, or t
  misc_feature (1138)..(1138): n is a, c, g, or t
  misc_feature (1141)..(1141): n is a, c, g, or t
  misc_feature (1153)..(1154): n is a, c, g, or t
  misc_feature (1167)..(1167): n is a, c, g, or t
  misc_feature (1170)..(1170): n is a, c, g, or t
naanagagagaattactatgagaggatcgcatcaccatcaccatcacggatcctatttaggtgacactatagaatcgtcgacccacgcgtccggtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactccaaaattccagcaatgaccattgcctaanaatgcaggtgttgaaggatcntttgatagttganaaaattatgcaaagttcctcaaaagttgggttatgangctatggctgggaaattttgtgaaatatgggnggnaaaaaggaatcnttgaccccacaaaangttgnggaaaactgcttttatgggaangcngcctggngnggncctctcngnttactaccgcnaaaanttgtagtccnaaaaantccntaaaaaaaaaaaanacccntgaaangggggccaatgaatngnaatgggaanggggtantgggaagnnggccatnttncaanccccaaanaanggctttcccttnnaaaagaaacgggnaanggaaacccc

SEQ ID NO: 68 - DNA, 864 bp, Homo sapiens
ctatgagaggtcgcatcaccatcaccatcacggatcctatttaggtgacactatagaatcgtcgacccacgcgtccggccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaagga

SEQ ID NO: 69 - DNA, 844 bp, Homo sapiens
  misc_feature (1)..(1): n is a, c, g, or t
  misc_feature (731)..(731): n is a, c, g, or t
  misc_feature (773)..(773): n is a, c, g, or t
  misc_feature (780)..(780): n is a, c, g, or t
  misc_feature (824)..(824): n is a, c, g, or t
nccgatagagagatactatgagaggatgcatcaccatcaccatcacggatcctatttaggtgacactatagaatcgtcgactctggaccttggctgtcactcagttaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaancagtgccatgttcattgggggttgaagtggtggtgttctttngaaaacnagtgggaaaaagtaagataatctgtagcatgcatcattcctggnctgaataaaagaaaagcctt

SEQ ID NO: 70 - DNA, 1103 bp, Homo sapiens
  misc_feature (942)..(942): n is a, c, g, or t
  misc_feature (967)..(967): n is a, c, g, or t
  misc_feature (977)..(977): n is a, c, g, or t
  misc_feature (983)..(983): n is a, c, g, or t
  misc_feature (987)..(987): n is a, c, g, or t
  misc_feature (1020)..(1020): n is a, c, g, or t
  misc_feature (1035)..(1035): n is a, c, g, or t
  misc_feature (1046)..(1046): n is a, c, g, or t
  misc_feature (1050)..(1050): n is a, c, g, or t
  misc_feature (1067)..(1067): n is a, c, g, or t
  misc_feature (1071)..(1071): n is a, c, g, or t
  misc_feature (1079)..(1080): n is a, c, g, or t
  misc_feature (1084)..(1084): n is a, c, g, or t
  misc_feature (1086)..(1089): n is a, c, g, or t
  misc_feature (1099)..(1100): n is a, c, g, or t
  misc_feature (1103)..(1103): n is a, c, g, or t
agaaattactatgagaggatcgcatcaccatcaccattcacggatcctatttaggtgacactattagaatcgtcgacccacgcgtccgggcttccccagcgaaaagagggtcaacgcggccttctacaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctganggccacaaagctagtttctgtctcnaaaaactgantgtcangagnatgtctccaaccggtatgagtgtgccaactttngaaaacaaggcatcnctgtgggttgntggnatctctaccggcatganattnactgtcannggantnnnntcccggatgnnaan

SEQ ID NO: 71 - DNA, 3097 bp, Homo sapiens
atggcaccggatctgccggaaatgctggatctggcaggcacccgtagccgtctggcaagcgttagcgcagatgcagaagttgcacgtcgtaaaagcgttccgagcgaaaccgttgttgaagatagccgtaccggtctgcctccggttaccgatgaaaaccatgtgattgtgaaaaccgatagccagctggaagatctgggttattgcgtgtttaataaatataccgttccgctgccgtcaccggttcaggatagcgaaaatctgagcggtgaaagcggcaccttttatgaaggcaccgatgataaagttcgtcgtgatctggcaaccgatctgagcctgattgaagttaaactggcagcagcaggtcgtgttaaagatgagtttagcgtggataaagaagcaagcgcacatattagcggtgataaaagcggtctgagcaaagagttcgatcaggaaaaaaaagcaaacgatcgtctggataccgttctggaaaaaagcgaagaacatgccgatagcaaagaacatgccaaaaaaaccgaagaagcaggcgacgaaattgaaacctttggtctgggtgttacctatgaacaggcactggcaaaagatctgagcattccgaccgatgcaagcagcgaaaaagcagaaaaaggtctgagcagcgttccggaaattgcagaagttgaaccgagcaaaaaagttgaacagggtctggattttgcagttcagggtcagctggatgtgaaaattagcgattttggtcagatggcaagcggtctgaatattgatgatcgtcgtgcaaccgaactgaaactggaagcaacccaggatatgaccccgagcagcaaagcaccgcaggaagcagatgcatttatgggtgttgaaagcggtcatatgaaagaaggcaccaaagttagcgaaaccgaggttaaagaaaaagttgccaaaccggatctggttcatcaggaagccgttgataaagaagaaagctacgaaagcagcggtgaacatgaaagcctgaccatggaaagcctgaaagccgatgaaggtaaaaaagaaacctctccggaaagcagcctgattcaggatgaaattgccgttaaactgagcgttgaaattccgtgtccgcctgcagttagcgaagcagatctggccaccgatgaacgtgcagatgtgcagatggaatttattcagggtccgaaagaagaatctaaagagacaccggatattagcattaccccgtctgatgttgcagaaccgctgcatgaaaccattgttagcgaaccggcagaaattcagagcgaagaagaagaaattgaagcccagggcgaatatgataaactgctgtttcgtagcgataccctgcagattaccgatctgggtgttagcggtgcacgtgaagaatttgttgaaacctgcccgagcgaacacaaaggtgttattgaaagcgtggtgaccatcgaagatgattttattaccgttgttcagaccaccaccgatgaaggtgaaagcggtagccatagcgttcgttttgcagcactggaacagccggaagttgaacgtcgtccgtcaccgcatgatgaagaagaatttgaggttgaagaagcagcagaagcacaggcagaaccgaaagatggttctccggaagcaccggcatctccggaacgtgaagaagttgcactgagcgaatataaaaccgaaacctatgacgattataaagacgaaaccaccatcgatgatagcattatggatgcagatagcctgtgggttgatacccaggatgatgatcgtagcattatgaccgaacagctggaaaccattcctaaagaagagaaagccgaaaaagaagcacgtcgtagcagcctggaaaaacatcgtaaagaaaaaccgtttaaaaccggtcgtggtcgtattagcacaccggaacgtaaagttgcaaaaaaagaaccgagcaccgttagccgtgatgaagttcgtcgcaaaaaagccgtgtataaaaaagccgaactggcgaaaaaaacagaagttcaggcacatagcccgagccgtaaatttattctgaaaccggcaattaaatatacccgtccgacccatctgagctgtgttaaacgtaaaaccaccgcagccggtggtgaaagcgcactggcaccgagcgtttttaaacaggccaaagataaagtttctgatggtgtgaccaaatctccggaaaaacgtagctctctgcctcgtccgagcagcattctgcctccgcgtcgtggtgtttctggtgatcgtgatgaaaatagctttagcctgaatagcagcattagcagcagcgcacgtcgtaccacccgtagcgaaccgattcgtcgtgcaggtaaaagcggcaccagcaccccgaccacaccgggtagcaccgcaattacaccgggtacacctccgagctatagcagccgtactccgggtacaccaggcactccgagctatccgcgtacaccgcatacccctggcaccccgaaaagcgcaattctggtgccgagcgaaaaaaaagttgcaattatccgtacccctccgaaatctccggcaaccccgaaacagctgcgtctgatcaatcagccgctgccggatctgaaaaacgtgaaaagcaaaattggcagcaccgataacattaaatatcagccgaaaggtggtcaggttcagattgtgaccaaaaaaatcgatctgagccatgttaccagcaaatgtggcagcctgaaaaatattcgtcatcgtccgggtggtggtcgtgtgaaaattgaatccgtgaaactggattttaaagagaaagcacaggcaaaagttggtagcctggataatgcacatcatgttccgggtggcggtaatgttaaaatcgacagccagaaactgaattttcgtgaacatgcaaaagcacgtgttgatcatggtgcagaaattattacccagtctccgggtcgtagcagcgttgcatctccgcgtcgtctgagcaatgttagcagctctggtagcattaatctgctggaatctccgcagctggcaaccctggcagaagatgttaccgcagcactggccaaacagggactgtaagcggccgcttaattaa

SEQ ID NO: 72 - DNA, 1148 bp, Homo sapiens
  misc_feature (921)..(921): n is a, c, g, or t
  misc_feature (927)..(927): n is a, c, g, or t
  misc_feature (937)..(937): n is a, c, g, or t
  misc_feature (951)..(951): n is a, c, g, or t
  misc_feature (958)..(958): n is a, c, g, or t
  misc_feature (972)..(972): n is a, c, g, or t
  misc_feature (980)..(980): n is a, c, g, or t
  misc_feature (987)..(988): n is a, c, g, or t
  misc_feature (1006)..(1006): n is a, c, g, or t
  misc_feature (1014)..(1014): n is a, c, g, or t
  misc_feature (1021)..(1021): n is a, c, g, or t
  misc_feature (1025)..(1025): n is a, c, g, or t
  misc_feature (1041)..(1041): n is a, c, g, or t
  misc_feature (1050)..(1050): n is a, c, g, or t
  misc_feature (1060)..(1060): n is a, c, g, or t
  misc_feature (1068)..(1072): n is a, c, g, or t
  misc_feature (1082)..(1085): n is a, c, g, or t
  misc_feature (1090)..(1090): n is a, c, g, or t
  misc_feature (1099)..(1099): n is a, c, g, or t
  misc_feature (1109)..(1110): n is a, c, g, or t
  misc_feature (1132)..(1132): n is a, c, g, or t
  misc_feature (1141)..(1141): n is a, c, g, or t
  misc_feature (1147)..(1147): n is a, c, g, or t
attagagaaattactatgagaggatcgcatcaccatcaccatcacggatcctatttaggtgacactatagaatcgtcgacccacgcgtccggagagactgcggcgggagggccaggccgtgggagagacgcgggaaagtgcgggtcgcagaggcacttgaccaccccgccctaggccgacccggcggacgcggcgtctggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcatccccggagcccagtgctggccccctacaggtggcagcccctgcccactcccatgctggtggccctggccccactgagcacgcctgagcctccggggccacgcttcgttctcaggaacaaaacctgaggcagcccctttggatgccctcacagccttgcttctctcancctagnttcccatttnggggacttcaggancccaaancccctaggactttnttgggaancccgttnnccccagggtgggtccccnccaggaanagtaggnaaanaattttttttccttanccattttcnaaaaacccantcatttcnnnnncatcatcttnnnntttgntgcccttcngggccagccnngggggaaaaaaaattttccaanctaggtttnggcccnt

SEQ ID NO: 73 - DNA, 867 bp, Homo sapiens
  misc_feature (623)..(623): n is a, c, g, or t
  misc_feature (675)..(675): n is a, c, g, or t
  misc_feature (711)..(711): n is a, c, g, or t
  misc_feature (716)..(716): n is a, c, g, or t
  misc_feature (736)..(736): n is a, c, g, or t
  misc_feature (754)..(754): n is a, c, g, or t
  misc_feature (772)..(772): n is a, c, g, or t
  misc_feature (783)..(783): n is a, c, g, or t
  misc_feature (795)..(795): n is a, c, g, or t
  misc_feature (832)..(832): n is a, c, g, or t
  misc_feature (837)..(837): n is a, c, g, or t
  misc_feature (843)..(843): n is a, c, g, or t
  misc_feature (845)..(845): n is a, c, g, or t
  misc_feature (849)..(850): n is a, c, g, or t
ttcattaaagaggagaaattaactatgagaggatcgcatcaccatcaccatcacggatcctatttaggtgacactatagaatcgtcgacccacgcgtccggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccgggagaccctacccaactgatttanagatgagaagtgggttactgggtcagatgaacaatccttccactaatggcgngaatggccatttaccaggagatgcactttgcagcanggaanattgccaaatgtccttgctncacagtatccatggcagncaaatgacatgtcgatgnatttgttaccnccaaatcatagnagggactttttggtggaacctcctgggcataataaanaaaanggaaangntgtnnaaattttgtcaacggga

SEQ ID NO: 74 - DNA, 948 bp, Homo sapiens
  misc_feature (3)..(3): n is a, c, g, or t
  misc_feature (7)..(7): n is a, c, g, or t
  misc_feature (900)..(900): n is a, c, g, or t
  misc_feature (924)..(924): n is a, c, g, or t
atngagnaattactatgagaggatcgcatcaccatcaccatcacggatcctatttaggtgacactatagaatcgtcgacccacgcgtccgagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgntggcttatacacctctggaatganaagagccttgctttattactcaat

SEQ ID NO: 75 - DNA, 912 bp, Homo sapiens
cgcatcaccatcaccatcacggatcctatttaggtgacactatagaatcgtcgacccacgcgtccgtgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctagcccaaactctgctctgagaaat

SEQ ID NO: 76 - DNA, 1072 bp, Homo sapiens
  misc_feature (768)..(768): n is a, c, g, or t
  misc_feature (861)..(861): n is a, c, g, or t
  misc_feature (870)..(870): n is a, c, g, or t
  misc_feature (874)..(874): n is a, c, g, or t
  misc_feature (877)..(877): n is a, c, g, or t
  misc_feature (906)..(906): n is a, c, g, or t
  misc_feature (922)..(922): n is a, c, g, or t
  misc_feature (927)..(927): n is a, c, g, or t
  misc_feature (969)..(969): n is a, c, g, or t
  misc_feature (978)..(978): n is a, c, g, or t
  misc_feature (983)..(983): n is a, c, g, or t
  misc_feature (991)..(991): n is a, c, g, or t
  misc_feature (1014)..(1015): n is a, c, g, or t
  misc_feature (1024)..(1024): n is a, c, g, or t
  misc_feature (1035)..(1035): n is a, c, g, or t
  misc_feature (1037)..(1038): n is a, c, g, or t
  misc_feature (1040)..(1040): n is a, c, g, or t
  misc_feature (1044)..(1044): n is a, c, g, or t
  misc_feature (1047)..(1047): n is a, c, g, or t
  misc_feature (1049)..(1049): n is a, c, g, or t
  misc_feature (1053)..(1054): n is a, c, g, or t
  misc_feature (1065)..(1065): n is a, c, g, or t
tagaggaaattactatgaagaggatcgcatcaccatcaccatcacggatcctatttaggtgacactatagaatcgtcgacccacgcgtccggtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccnaatggttttggtaccagtccactaaactccctctgctaggatatcagccctaaacatcgtggggggatctcttacggaaagtaggggctttanaatcccaanttancancttgcaggaattttgccaaggacccagcntcccgaaaatcctatntttcngggaatgttaactggggggggctgaatggcaatggccccaanttctccccnatcangggcatanatcttttcttccacaaaggggcnntaaaccggnttttgaccccncnncncccnccncngggnnggggtcccccncggtccc

SEQ ID NO: 77 - DNA, 1157 bp, Homo sapiens
  misc_feature (66)..(67): n is a, c, g, or t
  misc_feature (853)..(853): n is a, c, g, or t
  misc_feature (899)..(899): n is a, c, g, or t
  misc_feature (973)..(973): n is a, c, g, or t
  misc_feature (981)..(981): n is a, c, g, or t
  misc_feature (985)..(985): n is a, c, g, or t
  misc_feature (991)..(991): n is a, c, g, or t
  misc_feature (1007)..(1007): n is a, c, g, or t
  misc_feature (1012)..(1012): n is a, c, g, or t
  misc_feature (1027)..(1027): n is a, c, g, or t
  misc_feature (1035)..(1035): n is a, c, g, or t
  misc_feature (1047)..(1047): n is a, c, g, or t
  misc_feature (1051)..(1051): n is a, c, g, or t
  misc_feature (1061)..(1061): n is a, c, g, or t
  misc_feature (1063)..(1063): n is a, c, g, or t
  misc_feature (1067)..(1071): n is a, c, g, or t
  misc_feature (1085)..(1086): n is a, c, g, or t
  misc_feature (1095)..(1095): n is a, c, g, or t
  misc_feature (1102)..(1103): n is a, c, g, or t
  misc_feature (1106)..(1106): n is a, c, g, or t
  misc_feature (1111)..(1111): n is a, c, g, or t
  misc_feature (1113)..(1113): n is a, c, g, or t
  misc_feature (1122)..(1122): n is a, c, g, or t
  misc_feature (1152)..(1153): n is a, c, g, or t
gagaaattactatgagaggatcgcatcaccatcaccatcacggatcctatttaggtgacactatannaatcgtcgacccacgcgtccgccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaanatgcagtgatggctgactccggaggtcagcccccagctgaactcanccaggcaagctgaccgaggccttcaagtacttcctgcagggcatgggctacatggcctcatcctgcatgactcncctgtccnggtntcgtanagcctctctgaccaangcaancatccgttgatgggnaaccgggncccgcttctccnaccnggtccaaaanancgannnnnggaaattttttttnngggcccccnggggcannccntggangncccccggtnaaaggccctgtttcccaaaaaggggaaccnncccc

SEQ ID NO: 78 - DNA, 1575 bp, Homo sapiens
accaaaagccctccggcagaagaagcagcaagtccggaaaaagaagcaaaaagtccggttaaagaagaagccaaatcaccggcagaagcaaaatcacctgaaaaagaagaagcgaaaagccctgcagaagttaaatctccggaaaaagcaaaaagcccagcaaaagaagaggcaaaatctcctccggaagccaaaagtcctgagaaagaggaagctaaatctccagccgaagttaaaagccctgaaaaagcgaaatctcctgccaaagaggaagccaagagtccggctgaagccaaatccccagagaaagccaaatctccggtgaaagaagaggcgaagagtccagccgaagcgaaatcacccgttaaagaggaagcgaagtcccctgcggaagtgaaaagtccagaaaaagctaaaagtccgaccaaagaagaagcaaagtcgcctgagaaagcaaagtctccagaaaaagaggaagcaaagagcccagaaaaagcaaaatcaccggttaaagccgaagcaaaatctcccgagaaagcgaaaagtcccgtgaaagctgaggccaaatctcctgaaaaggccaaatcccctgttaaagaagaagctaaaagtcccgaaaaagccaagagcccagtgaaagaggaagcgaaatcaccggaaaaagcgaaatccccagtgaaagaagaagcaaagactccggaaaaggccaagagtcctgtcaaagaagaggccaagtccccagaaaaggcgaaaagcccagagaaggcaaaaaccctggatgttaaaagtccggaagcaaaaacccctgcgaaagaagaagcacgtagtccggcagataaatttccagagaaagctaagtcccctgtcaaagaggaagttaagtcgccagagaaggctaaatcaccactgaaagaggatgcaaaagcacccgagaaagaaattccgaaaaaagaagaggtgaaatcgcctgtaaaagaagaggaaaaaccgcaagaggtcaaagttaaagagcctccgaaaaaagccgaagaagaaaaagcaccggcaaccccgaaaaccgaagagaaaaaagactcgaagaaagaagaggcaccgaaaaaagaggctccgaaaccgaaagtggaagaaaaaaaagaacctgcagtggaaaagccgaaagaaagtaaagtggaagctaagaaagaagaagccgaagataaaaaaaaagtgccgaccccagaaaaagaagctccggcaaaagttgaagttaaagaagatgcgaaacctaaagaaaaaaccgaggtggccaaaaaagaaccggatgatgcaaaagccaaagaaccgagcaaaccggctgaaaaaaaagaggcagcaccggaaaaaaaagacaccaaagaggaaaaagccaaaaaacctgaagagaagccgaaaacagaagccaaagcgaaagaagatgataaaaccctgagcaaagaaccgtcaaaaccgaaagcagaaaaagccgaaaaatcaagcagcaccgatcagaaagatagcaaaccgccagaaaaagccaccgaagataaagcagccaaaggcaaataagcggccgcttga

SEQ ID NO: 79 - DNA, 638 bp, Homo sapiens
  misc_feature (1)..(1): n is a, c, g, or t
  misc_feature (51)..(51): n is a, c, g, or t
  misc_feature (221)..(221): n is a, c, g, or t
  misc_feature (263)..(263): n is a, c, g, or t
  misc_feature (279)..(279): n is a, c, g, or t
  misc_feature (301)..(301): n is a, c, g, or t
  misc_feature (306)..(306): n is a, c, g, or t
  misc_feature (310)..(310): n is a, c, g, or t
  misc_feature (326)..(326): n is a, c, g, or t
  misc_feature (383)..(383): n is a, c, g, or t
  misc_feature (395)..(395): n is a, c, g, or t
  misc_feature (405)..(405): n is a, c, g, or t
  misc_feature (409)..(409): n is a, c, g, or t
  misc_feature (427)..(427): n is a, c, g, or t
  misc_feature (429)..(429): n is a, c, g, or t
  misc_feature (444)..(444): n is a, c, g, or t
  misc_feature (448)..(449): n is a, c, g, or t
  misc_feature (458)..(458): n is a, c, g, or t
  misc_feature (460)..(460): n is a, c, g, or t
  misc_feature (462)..(462): n is a, c, g, or t
  misc_feature (484)..(484): n is a, c, g, or t
  misc_feature (487)..(487): n is a, c, g, or t
  misc_feature (495)..(495): n is a, c, g, or t
  misc_feature (507)..(507): n is a, c, g, or t
  misc_feature (509)..(509): n is a, c, g, or t
  misc_feature (512)..(512): n is a, c, g, or t
  misc_feature (516)..(516): n is a, c, g, or t
  misc_feature (521)..(521): n is a, c, g, or t
  misc_feature (536)..(536): n is a, c, g, or t
  misc_feature (543)..(544): n is a, c, g, or t
  misc_feature (549)..(549): n is a, c, g, or t
  misc_feature (575)..(575): n is a, c, g, or t
  misc_feature (577)..(577): n is a, c, g, or t
  misc_feature (594)..(594): n is a, c, g, or t
  misc_feature (597)..(597): n is a, c, g, or t
  misc_feature (601)..(601): n is a, c, g, or t
  misc_feature (605)..(605): n is a, c, g, or t
  misc_feature (607)..(607): n is a, c, g, or t
  misc_feature (617)..(617): n is a, c, g, or t
  misc_feature (626)..(626): n is a, c, g, or t
  misc_feature (631)..(631): n is a, c, g, or t
  misc_feature (633)..(633): n is a, c, g, or t
  misc_feature (636)..(636): n is a, c, g, or t
ntagagagattactatgagaggatcgcatcaccactcaccatcacggatcntatttaggtgacactatagaatcgtcgacccacgcgctccgcaggcgccgccgggacgggcacgggcgcgcgggctccggcgggcgccggctgccttcctccgtcgctcgctgtctctcccggccgcattctcctccgctgcggggccgagctctccccagcgctcgcangaaggaagaagggagccgaggacgccgagaagttcccgcggnagccgcggatcccggncaaggcggaggctgcggctccnacggngcangagcgcgatccacggngaggggcgtacggccaaagggtccgcggcgtggagcgctcggaccttccgctctccnccgggcgtgggncgggaccccntganacgcgcccacgaggggcncnagattcctaacttgngcgnngctaggcgnangnaggtgttgcagccgccggagancanatagctgncggcatgatgantntgnagcnagaanttgaacttggcgtcngaagcgnncgccncggattcccccgtaggagctgggtcncnaagggaatgtgttcgcngtnaatncccntngattggcctnagccattcnacagncnccnac

SEQ ID NO: 80 - DNA, 878 bp, Homo sapiens
ctatgagaggatcgcatcaccatcaccatcacggatcctatttaggtgacactatagaatcgtcgacccacgcgtccgcccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttc

SEQ ID NO: 81 - DNA, 1189 bp, Homo sapiens
  misc_feature (859)..(859): n is a, c, g, or t
  misc_feature (919)..(919): n is a, c, g, or t
  misc_feature (938)..(938): n is a, c, g, or t
  misc_feature (956)..(956): n is a, c, g, or t
  misc_feature (966)..(966): n is a, c, g, or t
  misc_feature (977)..(977): n is a, c, g, or t
  misc_feature (981)..(981): n is a, c, g, or t
  misc_feature (987)..(987): n is a, c, g, or t
  misc_feature (1006)..(1006): n is a, c, g, or t
  misc_feature (1031)..(1031): n is a, c, g, or t
  misc_feature (1034)..(1034): n is a, c, g, or t
  misc_feature (1047)..(1047): n is a, c, g, or t
  misc_feature (1053)..(1053): n is a, c, g, or t
  misc_feature (1055)..(1055): n is a, c, g, or t
  misc_feature (1057)..(1057): n is a, c, g, or t
  misc_feature (1064)..(1064): n is a, c, g, or t
  misc_feature (1068)..(1068): n is a, c, g, or t
  misc_feature (1073)..(1073): n is a, c, g, or t
  misc_feature (1084)..(1085): n is a, c, g, or t
  misc_feature (1090)..(1090): n is a, c, g, or t
  misc_feature (1092)..(1092): n is a, c, g, or t
  misc_feature (1094)..(1094): n is a, c, g, or t
  misc_feature (1099)..(1099): n is a, c, g, or t
  misc_feature (1105)..(1105): n is a, c, g, or t
  misc_feature (1107)..(1107): n is a, c, g, or t
  misc_feature (1116)..(1116): n is a, c, g, or t
  misc_feature (1124)..(1126): n is a, c, g, or t
  misc_feature (1142)..(1142): n is a, c, g, or t
  misc_feature (1147)..(1147): n is a, c, g, or t
  misc_feature (1153)..(1153): n is a, c, g, or t
  misc_feature (1158)..(1158): n is a, c, g, or t
  misc_feature (1165)..(1165): n is a, c, g, or t
  misc_feature (1171)..(1171): n is a, c, g, or t
  misc_feature (1176)..(1176): n is a, c, g, or t
  misc_feature (1178)..(1179): n is a, c, g, or t
tagagagaattactatgagaggatcgcatcaccatcaccatcacggatcctatttaggtgacactatagaatcgtcgacccacgcgtccgctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgagtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgancgagcgcgacgcggccaagcacaggctggtggtgctggtcaaggacaatggcgagcctcngcgctcggccacgccacgntgcacgtggttctggtgnaaggtttctnccagccctacntgcngctccntgagggggccccggcccangccaaggccgaattccctcaacgtntanctggggggtggantggccncngngtcgtcncttnttctntttcggggctnntgttncngnggggnggctgngncagaagaanagggggcnnngggggttcctgtccgngcccnaaggtnctttnccgggtntttggnggaangnngggcccggaa

SEQ ID NO: 82 - DNA, 1342 bp, Homo sapiens
  misc_feature (922)..(922): n is a, c, g, or t
  misc_feature (933)..(933): n is a, c, g, or t
  misc_feature (999)..(999): n is a, c, g, or t
  misc_feature (1012)..(1012): n is a, c, g, or t
  misc_feature (1019)..(1019): n is a, c, g, or t
  misc_feature (1021)..(1021): n is a, c, g, or t
  misc_feature (1041)..(1041): n is a, c, g, or t
  misc_feature (1053)..(1053): n is a, c, g, or t
  misc_feature (1055)..(1055): n is a, c, g, or t
  misc_feature (1058)..(1058): n is a, c, g, or t
  misc_feature (1076)..(1076): n is a, c, g, or t
  misc_feature (1078)..(1078): n is a, c, g, or t
  misc_feature (1090)..(1090): n is a, c, g, or t
  misc_feature (1108)..(1108): n is a, c, g, or t
  misc_feature (1112)..(1112): n is a, c, g, or t
  misc_feature (1122)..(1123): n is a, c, g, or t
  misc_feature (1146)..(1147): n is a, c, g, or t
  misc_feature (1163)..(1163): n is a, c, g, or t
  misc_feature (1171)..(1171): n is a, c, g, or t
  misc_feature (1174)..(1174): n is a, c, g, or t
  misc_feature (1205)..(1206): n is a, c, g, or t
  misc_feature (1210)..(1210): n is a, c, g, or t
  misc_feature (1216)..(1216): n is a, c, g, or t
  misc_feature (1221)..(1221): n is a, c, g, or t
  misc_feature (1230)..(1230): n is a, c, g, or t
  misc_feature (1235)..(1235): n is a, c, g, or t
  misc_feature (1240)..(1240): n is a, c, g, or t
  misc_feature (1248)..(1248): n is a, c, g, or t
  misc_feature (1271)..(1271): n is a, c, g, or t
  misc_feature (1284)..(1284): n is a, c, g, or t
  misc_feature (1287)..(1288): n is a, c, g, or t
  misc_feature (1294)..(1294): n is a, c, g, or t
  misc_feature (1302)..(1302): n is a, c, g, or t
  misc_feature (1320)..(1320): n is a, c, g, or t
  misc_feature (1331)..(1336): n is a, c, g, or t
  misc_feature (1338)..(1340): n is a, c, g, or t
aatagagaaattactatgagaggatcgcatcaccatcaccatcacggatcctatttaggtgacactatagaatcgtcgacccacgcgtccgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccnatgatgtgccntctccatatgaagtcagaggttttcctaccatatacttctctccagccaacaagaagctaaatccnaaaaaatatgaangggggcngngaattaagtgattttattanctatctacaaananaanctacaaccccccctgtantncaggaaaaaaancccaaaaaaaaaaaaagncccnggaggatccnnaagccgtacccaacccccctttnnaaaagaccctcccccnaaaagggnaanccttggggagaacaagaccctatgggaattnntccncccggnccaangaaaaaggnaaaanccganccggtaantttcccaacggttctacccccgntttggaaaacccnccnntttttngggttggnaaaaattttttgggaaanttggggggggnnnnnngnnntt

SEQ ID NO: 83 - DNA, 642 bp, Homo sapiens
  misc_feature (37)..(37): n is a, c, g, or t
tcgagaaatataaaaattatttgctttgtgagcgganacaatataatagattaattgtgagcggataacaatttacacagaattattaaagaggagaaattaactatgagaggatcgcatcaccatcaccatcacggatcctatttaggtgacactatagaatcgtcgacccacgcgtccgactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgag

SEQ ID NO: 84 - DNA, 1379 bp, Homo sapiens
  misc_feature (6)..(7): n is a, c, g, or t
  misc_feature (616)..(616): n is a, c, g, or t
  misc_feature (635)..(635): n is a, c, g, or t
  misc_feature (936)..(936): n is a, c, g, or t
  misc_feature (1294)..(1294): n is a, c, g, or t
  misc_feature (1361)..(1361): n is a, c, g, or t
cccccnncctagggatactagagaggatcgcatcaccatcaccatcacggtcgacccacgcgtccggccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatanacccagatgaagagaaggncaaacaggacccttcttattatctgaaaaataccaatgccgagacccgacagaccctgcaggacttctaccaggacgtccctaccactcaaaactcctccatacccctctcaatcccctcccccacccaatcatacctaaaaaccccaccctaccccctatctcaaatcattcttaaaaacccacctacactccctctatattcccctaacatacccctcccttcacctctattcctaaatccccacccaccacctttttcttacatacttcttcacaccactaacacatcaactctcccntctcccctcccaacaatcctctacccccccctccacctcctctaccaaacttcacctccacctacccacctacccaacctccattcccctcaacacatccatccaacctcccatatcactctacccccaaacctcccccacaccaccaccatcacctatccacccatctcttctcactcccccctacccaccctcctccaccccctaccaacctcccctcactccctctctttaccacccaaccccccctctacttccaccctccacctccctcactcatccctacacccctatcccttctatattcaccttactctccacactatcctatctctcaacctccttcatttccccccantctacccactttcttcccttcctaccccactcaccttctaccacactacacccctctctccctcatnctcaacccccaacctacc

SEQ ID NO: 85 - DNA, 762 bp, Homo sapiens
  misc_feature (3)..(3): n is a, c, g, or t
  misc_feature (638)..(638): n is a, c, g, or t
  misc_feature (656)..(656): n is a, c, g, or t
ttnactatgagaggatcgcatcaccatcaccatcacggatcctatttaggtgacactatagaatcgtcgacccacgcgtccgatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcnttaagaagagtgatttanaaaaagatttctgaagacagagctcctcaaaccattggtggatatcttctgccttcaccacagatcaaatacttcaagagccatttaataaatatggcagaactat

SEQ ID NO: 86 - DNA, 973 bp, Homo sapiens
  misc_feature (5)..(5): n is a, c, g, or t
  misc_feature (930)..(930): n is a, c, g, or t
  misc_feature (945)..(946): n is a, c, g, or t
  misc_feature (948)..(948): n is a, c, g, or t
  misc_feature (955)..(955): n is a, c, g, or t
  misc_feature (960)..(960): n is a, c, g, or t
  misc_feature (963)..(963): n is a, c, g, or t
agagngaattactatgagaggatcgcatcaccatcaccatcacggatcctatttaggtgacactatagaatcgtcgacccacgcgtccggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgntattatcaaatatgnnanaaatacngggcnccncatactggat

SEQ ID NO: 87 - DNA, 827 bp, Homo sapiens
  misc_feature (2)..(4): n is a, c, g, or t
tnnnaggagaattaactatgagaggatcgcatcaccatcaccatcacggatcctatttaggtgacactatagaatcgtcgacccacgcgtccggcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcc

SEQ ID NO: 88 - DNA, 1135 bp, Homo sapiens
  misc_feature (766)..(766): n is a, c, g, or t
  misc_feature (868)..(868): n is a, c, g, or t
  misc_feature (885)..(885): n is a, c, g, or t
  misc_feature (891)..(891): n is a, c, g, or t
  misc_feature (899)..(899): n is a, c, g, or t
  misc_feature (912)..(912): n is a, c, g, or t
  misc_feature (914)..(914): n is a, c, g, or t
  misc_feature (927)..(927): n is a, c, g, or t
  misc_feature (937)..(937): n is a, c, g, or t
  misc_feature (941)..(941): n is a, c, g, or t
  misc_feature (943)..(943): n is a, c, g, or t
  misc_feature (949)..(949): n is a, c, g, or t
  misc_feature (969)..(969): n is a, c, g, or t
  misc_feature (973)..(973): n is a, c, g, or t
  misc_feature (988)..(988): n is a, c, g, or t
  misc_feature (1005)..(1006): n is a, c, g, or t
  misc_feature (1013)..(1013): n is a, c, g, or t
  misc_feature (1051)..(1052): n is a, c, g, or t
  misc_feature (1065)..(1065): n is a, c, g, or t
  misc_feature (1074)..(1074): n is a, c, g, or t
  misc_feature (1078)..(1078): n is a, c, g, or t
  misc_feature (1080)..(1080): n is a, c, g, or t
  misc_feature (1087)..(1087): n is a, c, g, or t
  misc_feature (1095)..(1095): n is a, c, g, or t
  misc_feature (1097)..(1097): n is a, c, g, or t
  misc_feature (1100)..(1100): n is a, c, g, or t
  misc_feature (1113)..(1113): n is a, c, g, or t
  misc_feature (1118)..(1118): n is a, c, g, or t
  misc_feature (1131)..(1131): n is a, c, g, or t
atagagaaattactatgagaggatcgcatcaccatcaccatcacggatcctatttaggtgacactatagaatcgtcgacccacgcgtccgaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatanacccggagtgcacctgccccacgtgccaaaagcacagccgcgccttcctgcacgcactgctgcacagtgacaacacggccgcgctgcaccacctcacggtcnacaacatcgcctaccanctgcanctcatgancgccgtccgcacnancatcgtggaaaancgcttcccgnactncntgcggnacttcatgggcgccatgtangggnatcccaccctctgtnccacttgggccactgannctctggncctctgtgggaatcccactgggcttgacctggcattgnnaaaaggaaggaanaaagaaggnaggnanggcctgnaaaaaaantnaangattccttttttnaaagnttttttttttttnactt

SEQ ID NO: 89 - DNA, 764 bp, Homo sapiens
  misc_feature (754)..(755): n is a, c, g, or t
  misc_feature (758)..(758): n is a, c, g, or t
  misc_feature (764)..(764): n is a, c, g, or t
tatagagagatactatgagaggtcgcatcaccatcaccatcacggatcctatttaggtgacactatagaatcgtcgactctggaccttggctgtcactcagttataggtcccggcccgagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtcccaatgannaanaaatan

SEQ ID NO: 90 - DNA, 1033 bp, Homo sapiens
  misc_feature (775)..(775): n is a, c, g, or t
  misc_feature (794)..(794): n is a, c, g, or t
  misc_feature (869)..(869): n is a, c, g, or t
  misc_feature (901)..(901): n is a, c, g, or t
  misc_feature (915)..(915): n is a, c, g, or t
  misc_feature (921)..(921): n is a, c, g, or t
  misc_feature (923)..(923): n is a, c, g, or t
  misc_feature (961)..(962): n is a, c, g, or t
  misc_feature (964)..(964): n is a, c, g, or t
  misc_feature (968)..(968): n is a, c, g, or t
  misc_feature (972)..(972): n is a, c, g, or t
  misc_feature (975)..(976): n is a, c, g, or t
  misc_feature (978)..(978): n is a, c, g, or t
  misc_feature (984)..(984): n is a, c, g, or t
  misc_feature (998)..(998): n is a, c, g, or t
  misc_feature (1000)..(1000): n is a, c, g, or t
  misc_feature (1002)..(1002): n is a, c, g, or t
  misc_feature (1010)..(1010): n is a, c, g, or t
  misc_feature (1022)..(1022): n is a, c, g, or t
  misc_feature (1024)..(1024): n is a, c, g, or t
  misc_feature (1027)..(1027): n is a, c, g, or t
  misc_feature (1030)..(1030): n is a, c, g, or t
tagagaaattactatgagaggatcgcatcaccatcaccatcacggatcctatttaggtgacactatagaatcgtcgacccacgcgtccggtcgggccggaccttggagcgcgcgggccggcggcggcgcgagtggctcgggagcgcggctgatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctangccgcccccagcagcacanaccccgccgcctcctacggccgactctgggttcccttcaggtgttgttgtcggcagggctgtcagggcacatgcntggccggctggggtccccaccccgcggaaaanggtcctaaacccantggggnantgctgtgtctcctgggttctgcccacccgtgggccaannangaantccnagnngnaagggngggccttccaggtngnangggggggncaaaaacccccntnatnggnccc

SEQ ID NO: 91 - DNA, 839 bp, Homo sapiens
  misc_feature (652)..(652): n is a, c, g, or t
  misc_feature (696)..(696): n is a, c, g, or t
  misc_feature (758)..(758): n is a, c, g, or t
  misc_feature (815)..(816): n is a, c, g, or t
atactatgagaggacgcatcaccatcaccatcacggatcctatttaggtgacactatagaatcgtcgactctggaccttggctgtcactcagttgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcancagtctcggctggagcagctgagtgcggcagagctgcagagcangaaccagggccactgggctgactggctacaggcgtacagagcccggctgggacaggacctgnaaggcgctggggacgctgccgctggcaggctgagcacgtgcgcgtgatgcacgccanncacccgaatacgtgctgaggact

SEQ ID NO: 92 - DNA, 1234 bp, Homo sapiens
  misc_feature (743)..(743): n is a, c, g, or t
  misc_feature (750)..(750): n is a, c, g, or t
  misc_feature (775)..(775): n is a, c, g, or t
  misc_feature (807)..(807): n is a, c, g, or t
  misc_feature (810)..(810): n is a, c, g, or t
  misc_feature (828)..(828): n is a, c, g, or t
  misc_feature (831)..(831): n is a, c, g, or t
  misc_feature (834)..(834): n is a, c, g, or t
  misc_feature (854)..(854): n is a, c, g, or t
  misc_feature (870)..(870): n is a, c, g, or t
  misc_feature (874)..(874): n is a, c, g, or t
  misc_feature (904)..(904): n is a, c, g, or t
  misc_feature (930)..(930): n is a, c, g, or t
  misc_feature (933)..(933): n is a, c, g, or t
  misc_feature (937)..(937): n is a, c, g, or t
  misc_feature (946)..(946): n is a, c, g, or t
  misc_feature (956)..(956): n is a, c, g, or t
  misc_feature (963)..(963): n is a, c, g, or t
  misc_feature (968)..(968): n is a, c, g, or t
  misc_feature (970)..(970): n is a, c, g, or t
  misc_feature (972)..(972): n is a, c, g, or t
  misc_feature (991)..(991): n is a, c, g, or t
  misc_feature (1014)..(1014): n is a, c, g, or t
  misc_feature (1017)..(1017): n is a, c, g, or t
  misc_feature (1023)..(1023): n is a, c, g, or t
  misc_feature (1034)..(1034): n is a, c, g, or t
  misc_feature (1038)..(1038): n is a, c, g, or t
  misc_feature (1044)..(1044): n is a, c, g, or t
  misc_feature (1066)..(1066): n is a, c, g, or t
  misc_feature (1070)..(1070): n is a, c, g, or t
  misc_feature (1074)..(1075): n is a, c, g, or t
  misc_feature (1082)..(1083): n is a, c, g, or t
  misc_feature (1087)..(1087): n is a, c, g, or t
  misc_feature (1098)..(1099): n is a, c, g, or t
  misc_feature (1105)..(1105): n is a, c, g, or t
  misc_feature (1117)..(1117): n is a, c, g, or t
  misc_feature (1131)..(1131): n is a, c, g, or t
  misc_feature (1146)..(1146): n is a, c, g, or t
  misc_feature (1155)..(1155): n is a, c, g, or t
  misc_feature (1158)..(1159): n is a, c, g, or t
  misc_feature (1166)..(1167): n is a, c, g, or t
  misc_feature (1169)..(1169): n is a, c, g, or t
  misc_feature (1177)..(1177): n is a, c, g, or t
  misc_feature (1184)..(1184): n is a, c, g, or t
  misc_feature (1214)..(1214): n is a, c, g, or t
  misc_feature (1219)..(1219): n is a, c, g, or t
gagaaattactatgagaggatcgcatcaccatcaccatcacggatcctatttaggtgacactatagaatcgtcgacccacgcgtccgcggacgcgtgggcgcaaaatcatgctgccgtgttccgtgtgggaagcttgttgcaagaaggttgtgggaaaatcagcaagctctatggagacctgaagcatctgaagacgtttgactggggaatggtctggaacacggacctggtggagaccctggagctgcagaacctggtgctgtgtgcgctgcagaccgtcaatggagcagaggcgcagaaggagtcacggggcgcgcacgccggggaagactacaaggtgcggattgatgagtacgatcactccaagcccatccaggggcaacagaagaagccctttgaggagtactggaggaagcacaccctgtcctatgtggacgtcggcactgggaaggtcactgtggaatatagacccataatcgacaaaactttgaacgaggctgactgtgccaccgtccccccagccattcgctcctactgatgagacaagatgcggtgatgacagaatcagctttttgcacagccagagaacaacacatcacacacaagaaacagttgtgctcatgtgatgggggcctcagcgctaggaaggagtggactgttggcgcacgcagcagcttgaataaatctgaaagtcactacgctgcgtaagagaagccaaataaagcgcatgctgtgtacaganggtgtcnagaatgcctcctacgtgacgggaancaaatccgtggttccctgcaaactggcaggancanattccaaggcacaggaanaanctngcaggtaaaatgtgttcatnaccttctgcccatttnaccncaaaaaagctgggaaaaaaaatgctaaccnaaaaaaaaggtgaaagtaaataaaanttntcanctgggtgantgggtaaacntgcaggnttgcngncntgctttttttaaaaaactngggggtaaaaggactctcatacntcnttgggnaatgcaaaacnttcncccccntggaaaaagatttggcaccttntaanaaannaaatggnntttncccttaaaccnncaattntaaaatccgccncaaaaaaatttggnaaaaaaaaaaaggantttttcccnaannttttttnncnccccgaanggttttntccccaaaatttttcttggggggttttttnaaaangaaaaaaaaaaaatt

SEQ ID NO: 93 - DNA, 1053 bp, Homo sapiens
  misc_feature (858)..(858): n is a, c, g, or t
  misc_feature (901)..(901): n is a, c, g, or t
  misc_feature (911)..(911): n is a, c, g, or t
  misc_feature (932)..(932): n is a, c, g, or t
  misc_feature (934)..(934): n is a, c, g, or t
  misc_feature (936)..(936): n is a, c, g, or t
  misc_feature (956)..(956): n is a, c, g, or t
  misc_feature (961)..(962): n is a, c, g, or t
  misc_feature (967)..(967): n is a, c, g, or t
  misc_feature (971)..(971): n is a, c, g, or t
  misc_feature (974)..(974): n is a, c, g, or t
  misc_feature (979)..(979): n is a, c, g, or t
  misc_feature (983)..(983): n is a, c, g, or t
  misc_feature (988)..(988): n is a, c, g, or t
  misc_feature (1007)..(1008): n is a, c, g, or t
  misc_feature (1012)..(1012): n is a, c, g, or t
  misc_feature (1016)..(1016): n is a, c, g, or t
  misc_feature (1019)..(1019): n is a, c, g, or t
  misc_feature (1026)..(1026): n is a, c, g, or t
  misc_feature (1028)..(1028): n is a, c, g, or t
  misc_feature (1038)..(1038): n is a, c, g, or t
  misc_feature (1041)..(1041): n is a, c, g, or t
  misc_feature (1053)..(1053): n is a, c, g, or t
tagagaaattactatgagaggatcgcatcaccatcaccatcacggatcctatttaggtgacactatagaatcgtcgacccacgcgtccgcggacgcgtgggcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcaggtaaaagaaaccggccctacctcatgctgcggtcctcccagccctccggcaccccactccaaagtctggactctttccacatcctgctccagacagccaagctttgttggggtccccactgctttgagatggtgtgtagggtggtctgggcagttccctccatgccccccccagctaggaggccatcatcagtctgtacccaaggaagagtcatctgactctagaccctctggttgccacctctgacttgagccacagggtaccttgtgaaagaggtccccagtgacagcctccccagcctccctgtttcctttggctgtggcctcagagccctttccaggatgcctcagagcctcctgttgctgtttctgctcccagggaggcaggcaggagtctgtcctcttcacagtggccctcatcttactacctgcctctcttcccctagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggangcaccccgaaaaatgaaaagtacacacccatggaattcaagancctgaacaanaataacttgatccctgatganananccaacttctacccattgcancaaannaatgngtanacnaatanttantaccnagccccctgaaaaaaaaanntttncggnccnaaggctnanctggaaaaanggngtttcccaaaan

SEQ ID NO: 94 - DNA, 892 bp, Homo sapiens
catcaccatcaccatcacggatcctatttaggtgacactatagaatcgtcgacccacgcgtccggtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaataaaaagcaaggctatccagcacttcatgtattcagtactttcttctatcctaaattaaagtctgggggttaccaagcagtgaaacgatggaccaaaggggtaaatctctttgaacaagaaattat

SEQ ID NO: 95 - DNA, 810 bp, Homo sapiens
  misc_feature (706)..(706): n is a, c, g, or t
  misc_feature (755)..(755): n is a, c, g, or t
  misc_feature (758)..(758): n is a, c, g, or t
  misc_feature (793)..(794): n is a, c, g, or t
  misc_feature (803)..(803): n is a, c, g, or t
aatactatgagaggacgcatcaccatcaccatcacggatcctatttaggtgacactatagaatcgtcgactctggaccttggctgtcactcagttaaggaactgggctcatccacaaatgccttgagacagctactaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtnaaagtgaaatttttgtgaaggacttaatttatcagtgtttctttagccntgntgaactatgaaatacgaaggccttaattttgtacnnataactttnattttgt

SEQ ID NO: 96 - DNA, 1179 bp, Homo sapiens
  misc_feature (2)..(2): n is a, c, g, or t
  misc_feature (4)..(4): n is a, c, g, or t
  misc_feature (221)..(221): n is a, c, g, or t
  misc_feature (258)..(258): n is a, c, g, or t
  misc_feature (311)..(311): n is a, c, g, or t
  misc_feature (314)..(314): n is a, c, g, or t
  misc_feature (860)..(860): n is a, c, g, or t
  misc_feature (896)..(896): n is a, c, g, or t
  misc_feature (906)..(906): n is a, c, g, or t
  misc_feature (923)..(923): n is a, c, g, or t
  misc_feature (928)..(928): n is a, c, g, or t
  misc_feature (969)..(969): n is a, c, g, or t
  misc_feature (973)..(973): n is a, c, g, or t
  misc_feature (991)..(991): n is a, c, g, or t
  misc_feature (997)..(997): n is a, c, g, or t
  misc_feature (1006)..(1006): n is a, c, g, or t
  misc_feature (1008)..(1008): n is a, c, g, or t
  misc_feature (1021)..(1021): n is a, c, g, or t
  misc_feature (1032)..(1032): n is a, c, g, or t
  misc_feature (1038)..(1038): n is a, c, g, or t
  misc_feature (1040)..(1040): n is a, c, g, or t
  misc_feature (1042)..(1042): n is a, c, g, or t
  misc_feature (1056)..(1056): n is a, c, g, or t
  misc_feature (1064)..(1064): n is a, c, g, or t
  misc_feature (1066)..(1067): n is a, c, g, or t
  misc_feature (1082)..(1082): n is a, c, g, or t
  misc_feature (1086)..(1086): n is a, c, g, or t
  misc_feature (1121)..(1121): n is a, c, g, or t
  misc_feature (1134)..(1134): n is a, c, g, or t
  misc_feature (1137)..(1137): n is a, c, g, or t
  misc_feature (1141)..(1141): n is a, c, g, or t
  misc_feature (1155)..(1155): n is a, c, g, or t
  misc_feature (1160)..(1161): n is a, c, g, or t
  misc_feature (1166)..(1166): n is a, c, g, or t
  misc_feature (1168)..(1171): n is a, c, g, or t
gnantagagaaattactatgagaggatcgcatcaccatcaccatcacggatcctatttaggtgacactatagaatcgtcgacccacgcgtccgatccctcgcttcagattgacatacctgatgcgctcagtgagagagacaaagtcaaatttacagtgcacacaaagattccacctgctcctacgaagcccgactttgatggtcctcgagagaagatgcanaaactgggagaaggtgaagggtctatgaccaaagaanaatttgccaagatgaaacaagaactggaagctgagtatctcgctgtgtttaanaanactgtgtcctcccatgaagtctttcttcagcggctttcttctcaccctgttctcagtaaagatcgcaactttcatgttttcctggaatatgatcaggatctaagtgttaggcggaaaaatactaaagaaatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatganaactcaaacaaagctctggataaggcccggttaaanagcaaagacntcaagttggctgaggcncccancaggagtgctgccaaaatttgaacaactttccgaatctgcnaaanaaaactgaaaatttcaancggaanaaagggccncntttaaaaaaatcnaattgaaatgnccggancngnaaaaaaacatgccnggaaacangnncccctttttgcaaanctgnattgacttgttcaaaaaaactgaaatgccctcccncaaaaaaaaaaangangggnaaaaaaacccaccnccctnnccttnannnnttccccgg

SEQ ID NO: 97 - DNA, 673 bp, Homo sapiens
  misc_feature (531)..(531): n is a, c, g, or t
  misc_feature (541)..(542): n is a, c, g, or t
  misc_feature (556)..(556): n is a, c, g, or t
  misc_feature (558)..(559): n is a, c, g, or t
  misc_feature (575)..(575): n is a, c, g, or t
  misc_feature (580)..(580): n is a, c, g, or t
  misc_feature (583)..(583): n is a, c, g, or t
  misc_feature (595)..(595): n is a, c, g, or t
  misc_feature (600)..(600): n is a, c, g, or t
  misc_feature (612)..(613): n is a, c, g, or t
  misc_feature (615)..(615): n is a, c, g, or t
  misc_feature (617)..(617): n is a, c, g, or t
  misc_feature (625)..(625): n is a, c, g, or t
  misc_feature (630)..(630): n is a, c, g, or t
  misc_feature (636)..(636): n is a, c, g, or t
  misc_feature (644)..(644): n is a, c, g, or t
  misc_feature (646)..(646): n is a, c, g, or t
  misc_feature (651)..(651): n is a, c, g, or t
  misc_feature (655)..(655): n is a, c, g, or t
  misc_feature (663)..(663): n is a, c, g, or t
  misc_feature (666)..(666): n is a, c, g, or t
  misc_feature (669)..(673): n is a, c, g, or t
taagaggagaattaactatgagaggatcgcatcaccatcaccatcacggatcctatttaggtgacactatagaatcgtcgacccacgcgtccgcccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcggggagaggggacgcaggccccctctcctccgtggcacatggcacaagcacaanaagccaaccnnggagagagtcctgnannctctgggggggaaaanagggnggnacagggcccctnccctntgccttctcccnngnanaatggggnaaggnggaccntggaatgngnttggnaggnaaaggggnaanacnnnnn

SEQ ID NO: 98 - DNA, 1059 bp, Homo sapiens
  misc_feature (1)..(1): n is a, c, g, or t
  misc_feature (3)..(3): n is a, c, g, or t
  misc_feature (806)..(806): n is a, c, g, or t
  misc_feature (899)..(899): n is a, c, g, or t
  misc_feature (903)..(903): n is a, c, g, or t
  misc_feature (909)..(909): n is a, c, g, or t
  misc_feature (963)..(963): n is a, c, g, or t
  misc_feature (969)..(969): n is a, c, g, or t
  misc_feature (976)..(976): n is a, c, g, or t
  misc_feature (990)..(990): n is a, c, g, or t
  misc_feature (992)..(992): n is a, c, g, or t
  misc_feature (994)..(994): n is a, c, g, or t
  misc_feature (998)..(998): n is a, c, g, or t
  misc_feature (1010)..(1010): n is a, c, g, or t
  misc_feature (1013)..(1014): n is a, c, g, or t
  misc_feature (1026)..(1026): n is a, c, g, or t
  misc_feature (1029)..(1029): n is a, c, g, or t
  misc_feature (1037)..(1037): n is a, c, g, or t
  misc_feature (1042)..(1042): n is a, c, g, or t
  misc_feature (1045)..(1045): n is a, c, g, or t
ntnagagaaattactatgagaggatcgcatcaccatcaccatcacggatcctatttaggtgacactatagaatcgtcgacccacgcgtccgccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcanatctgattttcacatctctacctggacattgagcctccaggcaccatgttgaggagaaatgaaaaccagggcggtagaacttcagggtgaagnacanaattcntgggtggggcacggctgcaggcgcaccaaaaaacccagccaaagggggtgtgantaccantggtgtngcttccccctgcancngntggnatgaggtctgtntgnngtgtgtgaaccntcnttttttgntctcntgncccatgaaactttg

SEQ ID NO: 99 - DNA, 614 bp, Homo sapiens
  misc_feature (1)..(1): n is a, c, g, or t
  misc_feature (3)..(3): n is a, c, g, or t
  misc_feature (352)..(352): n is a, c, g, or t
  misc_feature (360)..(360): n is a, c, g, or t
  misc_feature (371)..(371): n is a, c, g, or t
  misc_feature (415)..(415): n is a, c, g, or t
  misc_feature (425)..(425): n is a, c, g, or t
  misc_feature (442)..(443): n is a, c, g, or t
  misc_feature (446)..(446): n is a, c, g, or t
  misc_feature (475)..(475): n is a, c, g, or t
  misc_feature (479)..(479): n is a, c, g, or t
  misc_feature (486)..(487): n is a, c, g, or t
  misc_feature (496)..(497): n is a, c, g, or t
  misc_feature (512)..(512): n is a, c, g, or t
  misc_feature (522)..(522): n is a, c, g, or t
  misc_feature (535)..(536): n is a, c, g, or t
  misc_feature (539)..(539): n is a, c, g, or t
  misc_feature (558)..(558): n is a, c, g, or t
  misc_feature (568)..(569): n is a, c, g, or t
  misc_feature (573)..(573): n is a, c, g, or t
  misc_feature (575)..(575): n is a, c, g, or t
  misc_feature (591)..(591): n is a, c, g, or t
  misc_feature (593)..(593): n is a, c, g, or t
  misc_feature (598)..(601): n is a, c, g, or t
  misc_feature (609)..(610): n is a, c, g, or t
  misc_feature (612)..(612): n is a, c, g, or t
ntngagaaattactatgagaggatcgcatcaccatcaccatcacggatcctatttaggtgacactatagaatcgtcgacccacgcgtccgtgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaccncttagcanagaaacgggancatgagagagagtgatccaaaggccattgaggaaaacacaactncttcagatgntaaagaaaaactggccnnaanatggattccaccaggaaacgggaggcccnctcnccccctnnttgaaacgnngcaaaaaaggaaaanccccccaagnggggggaaaaaannggncctttaaggaaaaaggccncccggttaanncctnanggcccaaaaaattttncnggttnnnnggggaaanntncc

SEQ ID NO: 100 - DNA, 931 bp, Homo sapiens
tgagaggtcgcatcaccatcaccatcacggatcctatttaggtgacactatagaatcgtcgacccacgcgtccgcccacgcgtccgcggacgcgtgggcgaggttcctcgcggacagctcagggttgctctcttgttctgaagacatgtccatcagatactgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattattttttaactttgttggaacggactggggtaacagtgggaaagcctccagttgcaatccttcaatgagctgagattgaatcattgactgtgaaagagccccctcctcccctctctcctgggccctcattccgggcaggtccccttcactcagcccccagtgtc

SEQ ID NO: 101 - DNA, 1061 bp, Homo sapiens
  misc_feature (958)..(958): n is a, c, g, or t
  misc_feature (994)..(994): n is a, c, g, or t
  misc_feature (1033)..(1033): n is a, c, g, or t
  misc_feature (1057)..(1057): n is a, c, g, or t
tagagagaattactatgagaggatcgcatcaccatcaccatcacggatcctatttaggtgacactatagaatcgtcgacccacgcgtccgcccacgcgtccgatgtaggcaccggtccgagtgcctgccctctgtccccgcggctgggtctcgtctgctccggttcctgggctcctaattcttggtccagcttcttccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacacgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaccgttacggtaatactttactttaggcatccctcctgttgctagcanccttttgacctatctgcatgcagtgttctcagtagnaatgttcctctgttacatggaaaaattgttgatggtgcnttgtaaattaaaaacccacttgcnaacc

SEQ ID NO: 102 - DNA, 882 bp, Homo sapiens
  misc_feature (720)..(720): n is a, c, g, or t
  misc_feature (759)..(759): n is a, c, g, or t
  misc_feature (761)..(762): n is a, c, g, or t
  misc_feature (769)..(769): n is a, c, g, or t
  misc_feature (803)..(803): n is a, c, g, or t
agagagatactatgagaggtcgcatcaccatcaccatcacggatcctatttaggtgacactatagaatcgtcgactctggaccttggctgtcactcagttagaaaccaacaaaggattttggagcaaaataaggaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctcntaaacgtagactctgtgcagctttgaagcctggaagacnanntactacnacatgtcaaagccatggtggcacatttctgctantatgaagataaatagaatacagttcaggatacactgattctgacacagcgtgagattcacagaactgttggaacaatac

SEQ ID NO: 103 - DNA, 1381 bp, Homo sapiens
  misc_feature (849)..(849): n is a, c, g, or t
  misc_feature (867)..(867): n is a, c, g, or t
  misc_feature (883)..(883): n is a, c, g, or t
  misc_feature (904)..(904): n is a, c, g, or t
  misc_feature (954)..(954): n is a, c, g, or t
  misc_feature (957)..(957): n is a, c, g, or t
  misc_feature (964)..(964): n is a, c, g, or t
  misc_feature (971)..(971): n is a, c, g, or t
  misc_feature (975)..(975): n is a, c, g, or t
  misc_feature (981)..(981): n is a, c, g, or t
  misc_feature (994)..(994): n is a, c, g, or t
  misc_feature (1007)..(1007): n is a, c, g, or t
  misc_feature (1013)..(1013): n is a, c, g, or t
  misc_feature (1017)..(1018): n is a, c, g, or t
  misc_feature (1027)..(1027): n is a, c, g, or t
  misc_feature (1039)..(1039): n is a, c, g, or t
  misc_feature (1052)..(1052): n is a, c, g, or t
  misc_feature (1056)..(1057): n is a, c, g, or t
  misc_feature (1068)..(1068): n is a, c, g, or t
  misc_feature (1076)..(1076): n is a, c, g, or t
  misc_feature (1092)..(1093): n is a, c, g, or t
  misc_feature (1097)..(1097): n is a, c, g, or t
  misc_feature (1099)..(1099): n is a, c, g, or t
  misc_feature (1136)..(1136): n is a, c, g, or t
  misc_feature (1138)..(1138): n is a, c, g, or t
  misc_feature (1164)..(1164): n is a, c, g, or t
  misc_feature (1172)..(1172): n is a, c, g, or t
  misc_feature (1177)..(1177): n is a, c, g, or t
  misc_feature (1195)..(1195): n is a, c, g, or t
  misc_feature (1199)..(1199): n is a, c, g, or t
  misc_feature (1214)..(1214): n is a, c, g, or t
  misc_feature (1222)..(1222): n is a, c, g, or t
  misc_feature (1230)..(1230): n is a, c, g, or t
  misc_feature (1238)..(1238): n is a, c, g, or t
  misc_feature (1251)..(1251): n is a, c, g, or t
  misc_feature (1262)..(1262): n is a, c, g, or t
  misc_feature (1264)..(1265): n is a, c, g, or t
  misc_feature (1267)..(1267): n is a, c, g, or t
  misc_feature (1291)..(1291): n is a, c, g, or t
  misc_feature (1296)..(1297): n is a, c, g, or t
  misc_feature (1304)..(1304): n is a, c, g, or t
  misc_feature (1313)..(1313): n is a, c, g, or t
  misc_feature (1324)..(1324): n is a, c, g, or t
  misc_feature (1326)..(1327): n is a, c, g, or t
  misc_feature (1334)..(1334): n is a, c, g, or t
  misc_feature (1339)..(1339): n is a, c, g, or t
  misc_feature (1343)..(1343): n is a, c, g, or t
  misc_feature (1348)..(1348): n is a, c, g, or t
  misc_feature (1354)..(1354): n is a, c, g, or t
  misc_feature (1359)..(1359): n is a, c, g, or t
  misc_feature (1368)..(1368): n is a, c, g, or t
  misc_feature (1376)..(1376): n is a, c, g, or t
tagagaaattactatgagaggatcgcatcaccatcaccatcacggatcctatttaggtgacactatagaatcgtcgacccacgcgtccggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtggcccnagttcaaggcacttcccnttgcctcattttgacnccattaacctgccagagaaanaaggtaaagaatgtgaccaaattgaaccttttctgcttggaaactgacanaanaggtgcnctgaagnccanacttgnaagccccgctggnaaaaaaaactganaccgcnaaannaaccgctgnttcagggtcgtncaaaacccggtcnttcnnaggagcccttngttccaanaaaaaaaaaaaatcanntgcngngggcctttttgggtttcctagttcagaaccttttccncnggttctggaaaaaaaacccaaaaacngcccggancttgnaaaaaaaaaggctgaggnaaancccaaaacccccccnttgggggnggcccccntcgggggnaaaacaaaaaaanggaccggcccncnncngaaaaagggggttagggaacccancccgnnccggggnggaaaaaanaaggacccccngnnggggggnccccnattnccccnttccgngaaancgggggggnaaccccgngggga

SEQ ID NO: 104 - DNA, 1179 bp, Homo sapiens
  misc_feature (850)..(850): n is a, c, g, or t
  misc_feature (915)..(915): n is a, c, g, or t
  misc_feature (977)..(977): n is a, c, g, or t
  misc_feature (997)..(997): n is a, c, g, or t
  misc_feature (1014)..(1014): n is a, c, g, or t
  misc_feature (1038)..(1038): n is a, c, g, or t
  misc_feature (1056)..(1056): n is a, c, g, or t
  misc_feature (1065)..(1065): n is a, c, g, or t
  misc_feature (1071)..(1071): n is a, c, g, or t
  misc_feature (1073)..(1073): n is a, c, g, or t
  misc_feature (1082)..(1082): n is a, c, g, or t
  misc_feature (1085)..(1085): n is a, c, g, or t
  misc_feature (1089)..(1089): n is a, c, g, or t
  misc_feature (1092)..(1092): n is a, c, g, or t
  misc_feature (1099)..(1099): n is a, c, g, or t
  misc_feature (1103)..(1103): n is a, c, g, or t
  misc_feature (1136)..(1136): n is a, c, g, or t
  misc_feature (1138)..(1138): n is a, c, g, or t
  misc_feature (1144)..(1144): n is a, c, g, or t
  misc_feature (1175)..(1175): n is a, c, g, or t
tagagaaattactatgagaggatcgcatcaccatcaccatcacggatcctatttaggtgacactatagaatcgtcgacccacgcgtccgcggacgcgtgggcggacgcgtggggttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagangctccagagtcagctacagttatatttgcaggagatacaaatctaagggatcgagaggttaccanatgtggtggtttacccaacaacattgtggatgtctgggagtttttgggcaaacctaaacatngccagtatacatgggatacncaaatgaactctatctnggaaaactgctgcttgtaacttcnttttgatcgaatattttncaaacaccnccaaananggacccttnttncccnaanttggacntctnggataaaaaaactggacgggggaaatttccaangnatcccnggggcctccgggccacttaaaaaaaaattgnaaaa

SEQ ID NO: 105 - DNA, 966 bp, Homo sapiens
catcaccatcaccatcacggatcctatttaggtgacactatagaatcgtcgacccacgcgtccgaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaa

SEQ ID NO: 106 - DNA, 849 bp, Homo sapiens
tgagaggatcgcatcaccatcaccatcacggatcctatttaggtgacactatagaatcgtcgacccacgcgtccggcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggca

SEQ ID NO: 107 - DNA, 971 bp, Homo sapiens
  misc_feature (2)..(2): n is a, c, g, or t
  misc_feature (4)..(4): n is a, c, g, or t
  misc_feature (10)..(10): n is a, c, g, or t
antnagaggnaaattactatgagaggatcgcatcaccatcaccattcacggatcctatttaggtgacactatagaatcgtcgacccacgcgtccgcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaag

SEQ ID NO: 108 - DNA, 860 bp, Homo sapiens
  misc_feature (730)..(730): n is a, c, g, or t
  misc_feature (747)..(747): n is a, c, g, or t
  misc_feature (751)..(751): n is a, c, g, or t
  misc_feature (754)..(754): n is a, c, g, or t
  misc_feature (758)..(758): n is a, c, g, or t
  misc_feature (761)..(761): n is a, c, g, or t
  misc_feature (764)..(764): n is a, c, g, or t
  misc_feature (778)..(778): n is a, c, g, or t
  misc_feature (783)..(783): n is a, c, g, or t
  misc_feature (787)..(787): n is a, c, g, or t
  misc_feature (794)..(794): n is a, c, g, or t
  misc_feature (802)..(802): n is a, c, g, or t
  misc_feature (805)..(805): n is a, c, g, or t
  misc_feature (835)..(835): n is a, c, g, or t
  misc_feature (837)..(837): n is a, c, g, or t
  misc_feature (845)..(845): n is a, c, g, or t
  misc_feature (848)..(850): n is a, c, g, or t
  misc_feature (859)..(859): n is a, c, g, or t
tagagaaattactatggagaggatcgcatcaccattcaccatcacggatcctatttaggtgacactatagaatcgtcgacccacgcgtccgcccacgcgtccgagcaccgccccctggacgagcgggccctgcaggagaagctgaagtactttcccgtgtgcgtgagcaccaagccggagcccgaggacgatgcagaagagggacttgggggtcttcccagcaacatcagctctgtcagctccttgctgctcttcaacaccactgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagccactcaaggcagacctacaagatggggtactaacagcaccaccaccacccccaccgcccccaccacctcccccagctcctgaggtgctggccagtgcatccccactcccaccctcaaccgcggcccctgtangccaaggcgccaggcangacnacngcancancancgcgtctccttcantccangganctcccanggaagtgntcnacccctccggtggccgggccactctgctanantccatccnccnnnctggggggna

SEQ ID NO: 109 - DNA, 1333 bp, Homo sapiens
  misc_feature (1)..(2): n is a, c, g, or t
  misc_feature (910)..(910): n is a, c, g, or t
  misc_feature (938)..(938): n is a, c, g, or t
  misc_feature (941)..(941): n is a, c, g, or t
  misc_feature (947)..(947): n is a, c, g, or t
  misc_feature (962)..(962): n is a, c, g, or t
  misc_feature (988)..(988): n is a, c, g, or t
  misc_feature (998)..(998): n is a, c, g, or t
  misc_feature (1001)..(1001): n is a, c, g, or t
  misc_feature (1004)..(1004): n is a, c, g, or t
  misc_feature (1024)..(1024): n is a, c, g, or t
  misc_feature (1035)..(1035): n is a, c, g, or t
  misc_feature (1045)..(1045): n is a, c, g, or t
  misc_feature (1056)..(1056): n is a, c, g, or t
  misc_feature (1060)..(1060): n is a, c, g, or t
  misc_feature (1081)..(1081): n is a, c, g, or t
  misc_feature (1096)..(1096): n is a, c, g, or t
  misc_feature (1122)..(1122): n is a, c, g, or t
  misc_feature (1125)..(1125): n is a, c, g, or t
  misc_feature (1134)..(1134): n is a, c, g, or t
  misc_feature (1146)..(1146): n is a, c, g, or t
  misc_feature (1156)..(1156): n is a, c, g, or t
  misc_feature (1161)..(1161): n is a, c, g, or t
  misc_feature (1163)..(1163): n is a, c, g, or t
  misc_feature (1170)..(1170): n is a, c, g, or t
  misc_feature (1180)..(1180): n is a, c, g, or t
  misc_feature (1183)..(1183): n is a, c, g, or t
  misc_feature (1193)..(1193): n is a, c, g, or t
  misc_feature (1203)..(1203): n is a, c, g, or t
  misc_feature (1206)..(1206): n is a, c, g, or t
  misc_feature (1219)..(1219): n is a, c, g, or t
  misc_feature (1221)..(1222): n is a, c, g, or t
  misc_feature (1228)..(1228): n is a, c, g, or t
  misc_feature (1232)..(1233): n is a, c, g, or t
  misc_feature (1239)..(1239): n is a, c, g, or t
  misc_feature (1249)..(1249): n is a, c, g, or t
  misc_feature (1254)..(1255): n is a, c, g, or t
  misc_feature (1260)..(1260): n is a, c, g, or t
  misc_feature (1262)..(1262): n is a, c, g, or t
  misc_feature (1267)..(1267): n is a, c, g, or t
  misc_feature (1271)..(1271): n is a, c, g, or t
  misc_feature (1278)..(1278): n is a, c, g, or t
  misc_feature (1286)..(1287): n is a, c, g, or t
  misc_feature (1294)..(1294): n is a, c, g, or t
  misc_feature (1299)..(1299): n is a, c, g, or t
  misc_feature (1302)..(1302): n is a, c, g, or t
  misc_feature (1304)..(1304): n is a, c, g, or t
  misc_feature (1313)..(1313): n is a, c, g, or t
nntagagagattactatgagaggatcgcatcaccatcaccatcacggatcctatttaggtgacactatagaatcgtcgacccacgcgtccgcccacgcgtccgctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttggtaaagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccaaatgactttcctgaacagtgtgggatgagatggatacaggtgatactatcaaccaaagcaccctggccctcaaagncaaaaccgttttcccaaaactacctttnaanccattncctgggaaaaatgtnggacctttggaaaccctgggaagggnaatggaatgnacnttnaaagggaaagggagcttgantgcccaagttntggcaagaancctttgaattntganttccttaatgacttggaattntgtttttggctgccnccaacctaaaaaaaaaaaaagctttnttnaattggttntaaaaacccccnggggaaattnaattntnaattctnggaaggattntanggaaaaattngccccgaaanttncttaaaccagttngnntttttngggnnaaaacnaaaaaaaatnaaaannccccncnaaaantttnacccccntttggccnntttgtcnatggnggntnaagattggngaccctttcccaggggcctc

SEQ ID NO: 110 - DNA, 833 bp, Homo sapiens
  misc_feature (674)..(674): n is a, c, g, or t
  misc_feature (696)..(696): n is a, c, g, or t
  misc_feature (772)..(772): n is a, c, g, or t
tatagagaattactatgagaggtcgcatcaccatcaccatcacggatcctatttaggtgacactatagaatcgtcgactctggaccttggctgtcactcagttgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctgctgatctggtcatccaacaggttgatgatagtgaagaagaagaagaanaagaaattaagcccaacattangtagctgtaatgtgaaccaacagagctggcatgtctgcaatttacattgacttcctgtatctctcccttctatggncggagtctagttaacaatttatcacactgactttaaagaatgatctgatataactgcatgc

SEQ ID NO: 111 - DNA, 1322 bp, Homo sapiens
  misc_feature (835)..(835): n is a, c, g, or t
  misc_feature (866)..(866): n is a, c, g, or t
  misc_feature (947)..(947): n is a, c, g, or t
  misc_feature (952)..(952): n is a, c, g, or t
  misc_feature (954)..(954): n is a, c, g, or t
  misc_feature (959)..(959): n is a, c, g, or t
  misc_feature (963)..(963): n is a, c, g, or t
  misc_feature (965)..(965): n is a, c, g, or t
  misc_feature (1016)..(1016): n is a, c, g, or t
  misc_feature (1018)..(1018): n is a, c, g, or t
  misc_feature (1028)..(1028): n is a, c, g, or t
  misc_feature (1035)..(1035): n is a, c, g, or t
  misc_feature (1041)..(1041): n is a, c, g, or t
  misc_feature (1070)..(1070): n is a, c, g, or t
  misc_feature (1092)..(1092): n is a, c, g, or t
  misc_feature (1112)..(1112): n is a, c, g, or t
  misc_feature (1114)..(1114): n is a, c, g, or t
  misc_feature (1127)..(1128): n is a, c, g, or t
  misc_feature (1130)..(1130): n is a, c, g, or t
  misc_feature (1150)..(1150): n is a, c, g, or t
  misc_feature (1168)..(1168): n is a, c, g, or t
  misc_feature (1178)..(1178): n is a, c, g, or t
  misc_feature (1184)..(1184): n is a, c, g, or t
  misc_feature (1193)..(1193): n is a, c, g, or t
  misc_feature (1198)..(1198): n is a, c, g, or t
  misc_feature (1201)..(1201): n is a, c, g, or t
  misc_feature (1213)..(1213): n is a, c, g, or t
  misc_feature (1221)..(1222): n is a, c, g, or t
  misc_feature (1224)..(1224): n is a, c, g, or t
  misc_feature (1249)..(1249): n is a, c, g, or t
  misc_feature (1253)..(1255): n is a, c, g, or t
  misc_feature (1265)..(1265): n is a, c, g, or t
  misc_feature (1267)..(1267): n is a, c, g, or t
  misc_feature (1269)..(1269): n is a, c, g, or t
  misc_feature (1271)..(1271): n is a, c, g, or t
  misc_feature (1273)..(1274): n is a, c, g, or t
  misc_feature (1289)..(1289): n is a, c, g, or t
  misc_feature (1295)..(1295): n is a, c, g, or t
  misc_feature (1297)..(1297): n is a, c, g, or t
  misc_feature (1299)..(1299): n is a, c, g, or t
  misc_feature (1317)..(1317): n is a, c, g, or t
tagagaaattactatgagaggatcgcatcaccatcaccatcacggatcctatttaggtgacactatagaatcgtcgacccacgcgtccgcccacgcgtccgtggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcanggggcggtagctccgggcccggatggtggangcccctttccgccctggccttgggttagccgcctcccggccagcgccatctccgcccttggtgctgcccccgggcggtacntgctntntccancgcnanttggcctcttcctctcttctttcctccaatcgtcttcttcaacttgggctncnttgtttgaanttccaangccttnctattcttttcaattctttttccccaaantttaattttttttttaaggttnacttaacccccccttttccntnattttcggctttnncntggtgaaagggcctctcccnaaggttcctctttccccntttttttttntggggncaacctccnttccnccnattttttttccngccttttnncnaaaaaaaaataaaattggaacttanggannnaaaaaatttngncnancnncccttttaaaaaaanaaaaangntngttttccaaaatttcccnaaatg

SEQ ID NO: 112 - DNA, 1346 bp, Homo sapiens
  misc_feature (1257)..(1257): n is a, c, g, or t
  misc_feature (1287)..(1287): n is a, c, g, or t
  misc_feature (1310)..(1310): n is a, c, g, or t
tactgacttacctataaataggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctggccctcagagtgaaatccagaaggagaaagccaacaaaggccagagccgggccatcgagcgcctggaaaaaaaaagttttgagaatgagttcctgctgctgctcacctcccccacggccgcaaatcgcatgcgagctcaattagctgaacctggaaccctgttgataaatccagaatgaacctcaaaactccatccggaattggtcaaaacccctcgttgccccccggggctttttatttgggagaaaccacgccacccttgccaaatttttcgggcacctgggaagccaaaacggaaaaaaaaaccctggaataacacccgtggaaattaccccagggactgaaagaaaaccttttcggggcttcgcccatgatgcctcccggccactataaaaatcgcccctgcatattaggcctttcttaaacacctcacaaaagaaccgcacacttgccaggccgtagtcctcttgcgaccnagcggatatgcccactaaataccaacgctncaaaactcgacgccaccaagganaaacaactatccccaacgacccacgacacatcagac

SEQ ID NO: 113 - DNA, 915 bp, Homo sapiens
ctatgagaggtcgcatcaccatcaccatcacggatcctatttaggtgacactatagaatcgtcgacccacgcgtccgctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgta

SEQ ID NO: 114 - DNA, 839 bp, Homo sapiens
  misc_feature (769)..(769): n is a, c, g, or t
gagagatactatgagaggtcgcatcccatcaccatcacggatcctatttaggtgacactatagaatcgtcgactctggaccttggctgtcactcagttggagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtcccccatggtatgactgagcagaaaatcatactttctcttgcttttanagatagccttgagctagttatctttcttttgtagatattgatcagatatttgtatgaaggatctagaagc

SEQ ID NO: 115 - DNA, 857 bp, Homo sapiens
  misc_feature (1)..(1): n is a, c, g, or t
ngatagagagatactatgagaggatgcatcccatcaccatcacggatcctatttaggtgacactatagaatcgtcgactctggaccttggctgtcactcagttaaaaatggagtgaagcaaataccatttccatctggtactccactgcacgctaattcaatggtttctgacaatgtgatacagtctacagcactaacaaacgtatcttctgctacgacacacttcataaaatgacgaactggagacgacaacaaagccaaagataaaattgaaaataaaggagataacaatgagagagaacacccatcaatagctggaagtgcctactctaagccaatagatgtttcccgtctggatcttcgaagtggatgcatcataactgctagaatacaccctgatgcatattctttgtatgtggaaagaatatatgtcgtgacaactaccacaatgacagttgtcactggcctggtgacatctggtcctcttgaacatatgccaaatcggatggtgattttacattgtaacctgaaacctgccaagatgaggggactattatctcacgcaatgtcaagtgtgctagttccccagaaaaattgaaatcctggctcctcccaatgggtctgttcctggacacagaattacttttgatgctttgccacgagagcctgacaaggagctgaatcctagcatgaccattgtgaagcgatccgcctgatcctcacactatgatgactgtgtggctacatcaaagcattccctttgaggtgaaaggaaaggattagtaggctccaacctgatcaacgtggatcaataaaagctccgctaacagagaaattcagacaactttaaggataag

SEQ ID NO: 116 - DNA, 912 bp, Homo sapiens
  misc_feature (2)..(2): n is a, c, g, or t
  misc_feature (346)..(346): n is a, c, g, or t
  misc_feature (366)..(366): n is a, c, g, or t
  misc_feature (455)..(455): n is a, c, g, or t
  misc_feature (484)..(484): n is a, c, g, or t
  misc_feature (490)..(490): n is a, c, g, or t
  misc_feature (495)..(495): n is a, c, g, or t
  misc_feature (504)..(504): n is a, c, g, or t
  misc_feature (537)..(537): n is a, c, g, or t
  misc_feature (637)..(637): n is a, c, g, or t
  misc_feature (666)..(666): n is a, c, g, or t
  misc_feature (678)..(678): n is a, c, g, or t
  misc_feature (698)..(698): n is a, c, g, or t
  misc_feature (721)..(721): n is a, c, g, or t
  misc_feature (730)..(730): n is a, c, g, or t
  misc_feature (740)..(740): n is a, c, g, or t
  misc_feature (748)..(748): n is a, c, g, or t
  misc_feature (755)..(755): n is a, c, g, or t
  misc_feature (781)..(781): n is a, c, g, or t
  misc_feature (790)..(790): n is a, c, g, or t
  misc_feature (792)..(792): n is a, c, g, or t
  misc_feature (794)..(794): n is a, c, g, or t
  misc_feature (799)..(799): n is a, c, g, or t
  misc_feature (803)..(803): n is a, c, g, or t
  misc_feature (821)..(822): n is a, c, g, or t
  misc_feature (846)..(846): n is a, c, g, or t
  misc_feature (848)..(848): n is a, c, g, or t
  misc_feature (855)..(855): n is a, c, g, or t
  misc_feature (858)..(858): n is a, c, g, or t
  misc_feature (862)..(863): n is a, c, g, or t
  misc_feature (868)..(868): n is a, c, g, or t
  misc_feature (872)..(872): n is a, c, g, or t
  misc_feature (878)..(879): n is a, c, g, or t
  misc_feature (881)..(881): n is a, c, g, or t
  misc_feature (890)..(890): n is a, c, g, or t
  misc_feature (899)..(899): n is a, c, g, or t
  misc_feature (905)..(905): n is a, c, g, or t
  misc_feature (907)..(907): n is a, c, g, or t
antagagaaattactatgagaggatcgcatcaccatcaccatcacggatcctatttaggtgacactatagaatcgtcgacccacgcgtccgcccacgcgtccggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacntgctggcctatctggccgangcctggggcatggacatcgaggtcaccaaccgagactacaagcggcctctgcacgaggcggcctccatgggccaccgagactgcgtgcnctacctgctgggccggggggcagcggtcnactgcntgaanaaggccgantggactcctctgatgatggcctgcacaaggaanaacctgggggtgatccaggagctggtggaacatggcgccaatccactcctgaagaacaaagatggctggaacagtttccacattgccagtcgagaaggcnaccctctgatcctccaagtacctgctcantgtttgcccagngtgccctggaatacagagancaaaattagaaggactcctctgnatactgcancaatgcatgnaccatttngaggcantcaaagtgcttctttaagaggtgccnatatgaacnanantacanaaanaattgttggcgtcaccgnnttgatggaactcaattcaattttntncacatcnaantctnntaagnctgntccttnnantaaaaatgnggctttgcntttcananaaaaa

SEQ ID NO: 117 - DNA, 492 bp, Homo sapiens
gatagagagatactatgagaggtcgcatcaccatcaccatcacggatcctatttaggtgacactatagaatcgtcgactctggaccttggctgtcactcagttggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 118 - DNA, 1393 bp, Homo sapiens
  misc_feature (1)..(1): n is a, c, g, or t
  misc_feature (868)..(868): n is a, c, g, or t
nccgcactccccctaaggaatactagagaggacgcatcccatcacatcacggtcgacccacgcgtccgggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagccccggcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagncttgcaggcccctcgacctctgccgcagcttctggacgacccccatgaggtggaaaaagccggtctgctcccatgaccaaaatggccaaggggggcgcaagctcaagaaaaaagggggtccctcttggggggcgataaaagcacaccaccggcgctctaccaaaagccccaacccacacccgcccacctccgatgggaacaccgttcccgcccccaacaaacctgacacttctccgctcacacgacacacgtcgaccactcacccacgcaatatccctctccatcaacactacatgattctctacaccacccatcccacccacacatatatgctctccacaacatcgaaatcttaagtccgactacacttaccccaaccgaacatcgcacacaccagacccagatcacccacataataaccaacacaaccaccgtacaacaatctactctatataacacctaaacagcttaaactatcataatatcatgcaccgactagtacacaaaaatctcgaatataaccat

SEQ ID NO: 119 - DNA, 879 bp, Homo sapiens
  misc_feature (687)..(687): n is a, c, g, or t
  misc_feature (741)..(741): n is a, c, g, or t
  misc_feature (744)..(744): n is a, c, g, or t
  misc_feature (761)..(761): n is a, c, g, or t
  misc_feature (773)..(773): n is a, c, g, or t
  misc_feature (817)..(817): n is a, c, g, or t
  misc_feature (821)..(821): n is a, c, g, or t
  misc_feature (841)..(843): n is a, c, g, or t
  misc_feature (877)..(877): n is a, c, g, or t
gagatactatgagaggtcgcatcccatcaccatcacggatcctatttaggtgacactatagaatcgtcgactctggaccttggctgtcactcagttagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctaccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagncacctggcccaggtgatccgcccaggagtcgaggaccggctggcagcctctganggnagagacgcgcaggccanggccgagctggncacgctgcaggcccgcagcagctggagctgggagagtgcaccgnaggntgagacagcctcgcgagaannngagagcgtgagcagctccggaccacatgagctgngt

SEQ ID NO: 120 - DNA, 869 bp, Homo sapiens
  misc_feature (720)..(720): n is a, c, g, or t
agagagatactatgagaggtcgcatcaccatcaccatcacggatcctatttaggtgacactatagaatcgtcgactctggaccttggctgtcactcagttatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggctggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatgagaggacagccaaggactctcccgggcctctccggttctcccttgcggaatgatgggcgcatcctgtctgcacgtgctgacggtcgggaagctcantggagaggctactctaatgtcgctgctaagcaatcaggctcctgtccaggaatttgggtgacagttctgccttagataatgataatatctatgacactcaccttaaatattcttctatctgtcagaaagaaactggtttatcttaaaaa

SEQ ID NO: 121 - DNA, 1146 bp, Homo sapiens
  misc_feature (7)..(7): n is a, c, g, or t
  misc_feature (11)..(11): n is a, c, g, or t
  misc_feature (863)..(863): n is a, c, g, or t
  misc_feature (887)..(887): n is a, c, g, or t
  misc_feature (917)..(917): n is a, c, g, or t
  misc_feature (956)..(956): n is a, c, g, or t
  misc_feature (983)..(983): n is a, c, g, or t
  misc_feature (993)..(993): n is a, c, g, or t
  misc_feature (1001)..(1001): n is a, c, g, or t
  misc_feature (1020)..(1020): n is a, c, g, or t
  misc_feature (1025)..(1025): n is a, c, g, or t
  misc_feature (1036)..(1036): n is a, c, g, or t
  misc_feature (1042)..(1042): n is a, c, g, or t
  misc_feature (1055)..(1055): n is a, c, g, or t
  misc_feature (1059)..(1060): n is a, c, g, or t
  misc_feature (1065)..(1065): n is a, c, g, or t
  misc_feature (1070)..(1070): n is a, c, g, or t
  misc_feature (1076)..(1076): n is a, c, g, or t
  misc_feature (1089)..(1090): n is a, c, g, or t
  misc_feature (1093)..(1093): n is a, c, g, or t
  misc_feature (1098)..(1098): n is a, c, g, or t
  misc_feature (1101)..(1101): n is a, c, g, or t
  misc_feature (1120)..(1120): n is a, c, g, or t
  misc_feature (1125)..(1125): n is a, c, g, or t
  misc_feature (1132)..(1132): n is a, c, g, or t
  misc_feature (1144)..(1144): n is a, c, g, or t
aggaaanttanctatgaagaggatcgcatcaccatcaccatcacggatcctatttaggtgacactatagaatcgtcgacccacgcgtccggtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacnaagttgacgctgcatgggttgcancagtactacgtgaaactgaaggacaacganaagaaccggaagctctttgaccttctggatgtccttganttcaaccaggtggtgatctttgtgaantctgggcacnggtgcatngccttggcccacctactantggancaaaactcccngccatngccatcccccggnggannccccnagaanaaaagncttttcccggaannacnatttnaanattttcacaaaaattttgnggctncaacctnttggccaagctnga

SEQ ID NO: 122 - DNA, 1190 bp, Homo sapiens
  misc_feature (979)..(979): n is a, c, g, or t
  misc_feature (987)..(987): n is a, c, g, or t
  misc_feature (990)..(990): n is a, c, g, or t
  misc_feature (995)..(995): n is a, c, g, or t
  misc_feature (1001)..(1001): n is a, c, g, or t
  misc_feature (1014)..(1014): n is a, c, g, or t
  misc_feature (1023)..(1023): n is a, c, g, or t
  misc_feature (1077)..(1077): n is a, c, g, or t
  misc_feature (1089)..(1089): n is a, c, g, or t
  misc_feature (1098)..(1098): n is a, c, g, or t
  misc_feature (1120)..(1120): n is a, c, g, or t
  misc_feature (1123)..(1123): n is a, c, g, or t
  misc_feature (1127)..(1127): n is a, c, g, or t
  misc_feature (1129)..(1129): n is a, c, g, or t
  misc_feature (1139)..(1139): n is a, c, g, or t
  misc_feature (1152)..(1152): n is a, c, g, or t
  misc_feature (1155)..(1155): n is a, c, g, or t
  misc_feature (1160)..(1160): n is a, c, g, or t
  misc_feature (1164)..(1164): n is a, c, g, or t
  misc_feature (1169)..(1169): n is a, c, g, or t
  misc_feature (1173)..(1173): n is a, c, g, or t
  misc_feature (1177)..(1177): n is a, c, g, or t
  misc_feature (1179)..(1179): n is a, c, g, or t
  misc_feature (1182)..(1182): n is a, c, g, or t
  misc_feature (1186)..(1186): n is a, c, g, or t
tagagaaattactatgagaggatcgcatcaccatcaccatcacggatcctatttaggtgacactatagaatcgtcgacccacgcgtccgccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaatggggcagggcaagggtgggagtgtgcaaagccctgatctggagttacctgaggccatagctgcccctatnccttctanggncctgntttganatggttgttctanttattttanctaggtaagctgggggaaggtggggccctggtccctcacctcctggggaggganaaggggagctcnttttttacntgatttttttttcacccggttnccntttncntccccccttngggcccgggggtncanccttncccnttggncccnggangnttnttgntcca

SEQ ID NO: 123 - DNA, 856 bp, Homo sapiens
  misc_feature (836)..(837): n is a, c, g, or t
cccgaacaataagaaatactagagaggatgcatcccatcaccatcacggatcctatttaggtgacactatagaatcgtcgactctggaccttggctgtcactcagttatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaatttctagcagcacaacatcacacaacatatgaaagtaaaaagcctagaagatgcagaaaagaatcccaagcccatgacacgtggattgagacatctctgaatacanncgtctagcccctgcgatgt

SEQ ID NO: 124 - DNA, 1347 bp, Homo sapiens
  misc_feature (644)..(644): n is a, c, g, or t
cgtccctgccttaggaatacttgagaggatgcatcacatcacatcacggtcgacccacgcgtccgctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcangtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtaacaaaaaggtctctctgtttctccaactcaacttcaaaataacctgggaggccaaaaaaaggtcagctcttctagatcgggcagtgcttaaaaccgggagctccaccgggcgcaagggtcatgccataaatcccacacttttcgaacccaagggtgaaagatttctttaagcccaaatttcaaaacacccttgggaaacaaaaaaaacccttttttttaaaaaaatacccaaagggaaaaccgggaaatttttcccaaaatttattcaccccccccccaaccctgaaaaaactgcagagaggggttggtttttccaaaaaaatttccccccccccaaaaagaaaaacccacccctcttccccccagtttttttgtcttctaagatccactcccccccgaggggatacaccaaacaccctctcatatcactcctataaaaaaacacactcccccaccacccctcctggacaacacataactttgaaaaaaacaaacattcctcccctctgattccctaaaccccataaaagaaactcctcccccgttcgc

SEQ ID NO: 125 - DNA, 632 bp, Homo sapiens
agatactatgagaggtcgcatcaccatcaccatcacggatcctatttaggtgacactatagaatcgtcgactctggaccttggctgtcactcagtttttggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaaaaatggggctgttgtactctcactttacttatccttaaatttaaatacatacttatgtttgtattaatctatcaatatatgcatacatgaatat

SEQ ID NO: 126 - DNA, 968 bp, Homo sapiens
  misc_feature (1)..(1): n is a, c, g, or t
  misc_feature (804)..(804): n is a, c, g, or t
  misc_feature (942)..(942): n is a, c, g, or t
  misc_feature (946)..(968): n is a, c, g, or t
naattagagaaattactatgagaggatcgcatcaccatcaccatcacggatcctatttaggtgacactatagaatcgtcgacccacgcgtccgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcancgagcaggcgtgtgcgtgtgtggggcaggcaggatgtggtgcaggcaggttccatcgctttcgactctcactccaaagcagtagggccgcgttgctgctcactctctgcatagcatggtctgcactggaaaaattggncggnnnnnnnnnnnnnnnnnnnnnnn

SEQ ID NO: 127 - DNA, 1000 bp, Homo sapiens
  misc_feature (783)..(783): n is a, c, g, or t
  misc_feature (800)..(800): n is a, c, g, or t
  misc_feature (805)..(805): n is a, c, g, or t
  misc_feature (859)..(859): n is a, c, g, or t
  misc_feature (908)..(908): n is a, c, g, or t
  misc_feature (922)..(922): n is a, c, g, or t
  misc_feature (940)..(940): n is a, c, g, or t
  misc_feature (945)..(946): n is a, c, g, or t
  misc_feature (952)..(952): n is a, c, g, or t
  misc_feature (955)..(955): n is a, c, g, or t
  misc_feature (960)..(962): n is a, c, g, or t
  misc_feature (975)..(976): n is a, c, g, or t
  misc_feature (992)..(992): n is a, c, g, or t
  misc_feature (995)..(996): n is a, c, g, or t
  misc_feature (1000)..(1000): n is a, c, g, or t
aatagagaaattactatgagaggatcgcatcaccatcaccatcacggatcctatttaggtgacactatagaatcgtcgacccacgcgtccgctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccangagtctggtcagggcancacancgggccccctacggcccccaccccctggggctgggggtccagcgacaccttccnaaggcaacccggttcctcccaatggatcctgccacctttccggcgcaanaaacccaaaagtgngggttggcctggaaaccnaccanncccctnaantcatnnnggccccctcccannggaagaagaaacttcntgnnaaan

SEQ ID NO: 128 - DNA, 992 bp, Homo sapiens
tgagaggatcgcatcaccatcaccatcacggatcctatttaggtgacactatagaatcgtcgacccacgcgtccgtctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaatgtgtggtttttccc

SEQ ID NO: 129 - DNA, 609 bp, Homo sapiens
  misc_feature (1)..(1): n is a, c, g, or t
  misc_feature (3)..(3): n is a, c, g, or t
  misc_feature (10)..(10): n is a, c, g, or t
  misc_feature (14)..(14): n is a, c, g, or t
  misc_feature (22)..(22): n is a, c, g, or t
  misc_feature (42)..(43): n is a, c, g, or t
  misc_feature (84)..(84): n is a, c, g, or t
  misc_feature (101)..(101): n is a, c, g, or t
  misc_feature (104)..(104): n is a, c, g, or t
  misc_feature (157)..(161): n is a, c, g, or t
  misc_feature (169)..(169): n is a, c, g, or t
  misc_feature (172)..(172): n is a, c, g, or t
  misc_feature (183)..(183): n is a, c, g, or t
  misc_feature (196)..(196): n is a, c, g, or t
  misc_feature (262)..(262): n is a, c, g, or t
  misc_feature (275)..(276): n is a, c, g, or t
  misc_feature (285)..(285): n is a, c, g, or t
  misc_feature (320)..(323): n is a, c, g, or t
  misc_feature (335)..(335): n is a, c, g, or t
  misc_feature (341)..(341): n is a, c, g, or t
  misc_feature (391)..(391): n is a, c, g, or t
  misc_feature (393)..(394): n is a, c, g, or t
  misc_feature (396)..(397): n is a, c, g, or t
  misc_feature (486)..(486): n is a, c, g, or t
  misc_feature (524)..(524): n is a, c, g, or t
  misc_feature (537)..(537): n is a, c, g, or t
ncnaaatagncttncaaacccnaattctttgggccccaaaannttacctatgagaggatcgcatcaccataaccatcacggatnctatttaggggacactntanaatcgtcgacccacgcgtccgcaacaccacgatcaccagctatctggtccagnnnnnttacttcnccnaccaatacatnacagaatactttntctccaagtgcatttgattatgacacagaaaatatgaactctgaagatatttatagctctcttagnggggtcactgaannttttttttntttcagcttccgtagccaagaagatatgaatgagnnnntgaaaagggatncccccnaaagatgatggcgattcaatgtgtggtggtcctgggatgtctgacccaanannannaagagatgctactgactcaagtcaaacagctcttgataataaagcttcattgctccattcaatgcctactcactcctctccacgctctngagactataatccatataactattcagatagcatcagncccttcaacaagnctgccctcaaggaagccatgtttgatgatgatgctgaccagtttcctgacgatctttccctagatcattctg

SEQ ID NO: 130 - DNA, 1260 bp, Homo sapiens
tttagataatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgaacgctcgcccagcgagtgccacgagcatgcaaactgcctcctaaaacgcgatggctcgcggccgggctggggggcccttggttggccgggcaacggaacctctgtgggcccgaaactgaacctaaagggttccccgaaaaaaaattgccctgcccggaaccccaaaggccctaaggaatcatgcgggacggggccccacccagggccggagattcgggaaccccaatgccactcaaaaacccctgctacccaaatcccaagaagaacgtcatccacaaataataaaaaaacaccccttatggaagaaaacccatatcacctaatccgcattaataaattgttggggccattcacaccaatataacccgctccataacaacacaatcacccacccaacaacataacacacacaggtcactctcttttccatcacacattattccactctccgtcattcttcctccttactccctttctttataacacatctcatccccctctaccaaccaaagcacacaacacccacaaagactcccaacagcaccactcccctcttcatacacgcaaccttccacgcaaccaacactagttactcgtacattctat

SEQ ID NO: 131 - DNA, 927 bp, Homo sapiens
atgagaggtcgcatcaccatcaccatcacggatcctatttaggtgacactatagaatcgtcgacccacgcgtccgcccacgcgtccgattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctcc

SEQ ID NO: 132 - DNA, 1027 bp, Homo sapiens
  misc_feature (1)..(1): n is a, c, g, or t
  misc_feature (817)..(817): n is a, c, g, or t
  misc_feature (829)..(829): n is a, c, g, or t
  misc_feature (835)..(835): n is a, c, g, or t
  misc_feature (842)..(842): n is a, c, g, or t
  misc_feature (849)..(849): n is a, c, g, or t
  misc_feature (851)..(851): n is a, c, g, or t
  misc_feature (862)..(862): n is a, c, g, or t
  misc_feature (875)..(875): n is a, c, g, or t
  misc_feature (903)..(903): n is a, c, g, or t
  misc_feature (918)..(918): n is a, c, g, or t
  misc_feature (928)..(928): n is a, c, g, or t
  misc_feature (931)..(931): n is a, c, g, or t
  misc_feature (955)..(955): n is a, c, g, or t
  misc_feature (963)..(963): n is a, c, g, or t
  misc_feature (979)..(979): n is a, c, g, or t
  misc_feature (988)..(990): n is a, c, g, or t
  misc_feature (994)..(994): n is a, c, g, or t
  misc_feature (999)..(999): n is a, c, g, or t
  misc_feature (1011)..(1011): n is a, c, g, or t
  misc_feature (1014)..(1014): n is a, c, g, or t
  misc_feature (1017)..(1017): n is a, c, g, or t
  misc_feature (1020)..(1020): n is a, c, g, or t
  misc_feature (1022)..(1022): n is a, c, g, or t
  misc_feature (1024)..(1024): n is a, c, g, or t
naatagagaaattactatgagaggatcgcatcaccatcaccatcacggatcctatttaggtgacactatagaatcgtcgacccacgcgtccggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccangggtcccctcancctcancactcancgcaaantntggccttgganccacctgatgacncgaagctgcacatctaactgtggcccangctgggcccccaacntgggaatgcncanagtgtccccaacgcaagcccccanttttgaancctgccctggggcaancctccgaannntgantgggntacgggggaagnccnccnccnangnccc

SEQ ID NO: 133 - DNA, 1081 bp, Homo sapiens
  misc_feature (636)..(636): n is a, c, g, or t
  misc_feature (822)..(822): n is a, c, g, or t
  misc_feature (875)..(875): n is a, c, g, or t
  misc_feature (906)..(906): n is a, c, g, or t
  misc_feature (908)..(909): n is a, c, g, or t
  misc_feature (916)..(916): n is a, c, g, or t
  misc_feature (922)..(922): n is a, c, g, or t
  misc_feature (957)..(957): n is a, c, g, or t
  misc_feature (970)..(970): n is a, c, g, or t
  misc_feature (974)..(974): n is a, c, g, or t
  misc_feature (987)..(987): n is a, c, g, or t
  misc_feature (992)..(992): n is a, c, g, or t
  misc_feature (998)..(998): n is a, c, g, or t
  misc_feature (1009)..(1009): n is a, c, g, or t
  misc_feature (1011)..(1011): n is a, c, g, or t
  misc_feature (1017)..(1017): n is a, c, g, or t
  misc_feature (1026)..(1026): n is a, c, g, or t
  misc_feature (1031)..(1031): n is a, c, g, or t
  misc_feature (1034)..(1035): n is a, c, g, or t
  misc_feature (1040)..(1040): n is a, c, g, or t
  misc_feature (1045)..(1045): n is a, c, g, or t
  misc_feature (1051)..(1051): n is a, c, g, or t
  misc_feature (1063)..(1063): n is a, c, g, or t
  misc_feature (1074)..(1075): n is a, c, g, or t
  misc_feature (1078)..(1078): n is a, c, g, or t
  misc_feature (1080)..(1080): n is a, c, g, or t
agaaattaactatgagaggatcgcatcaccatcaccatcacggatcctatttaggtgacactatagaatcgtcgacccacgcgtccgcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatgggggtaagggctgggccaaaggggcatgaggaacgggaatgttgccctgtgtggggcctgtggggtgccagggagagatgggcacatctcttgcccttgagggcaaggggcatcccaaaagctgttggatgtggtggctcagtgggaggcaaggctctggggatgtacatgccctctactgccctccccctttgtgcctgatagggagcctcccggcgggttgagagtggggcatgggcatacctgagccccctggtgctgcgtaaggagctggagtcgctggtanagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccanccctctgttcaggtacggctgctgtgggatgtactgacccctgaccccaatanctgcccacctctctatgtgctctggaaggtncnnaattgantctggnatttggcctgggtggggaagggtggggtcccatancccaaaaaggctnaatnaattctggggggnctttnttttcnttttcatccangncaaaantcccccaancgggnggnnaaggnccagnccctgnaactgcatcccnttaatttggcnntgntng

SEQ ID NO: 134 - DNA, 1277 bp, Homo sapiens
  misc_feature (838)..(838): n is a, c, g, or t
  misc_feature (860)..(860): n is a, c, g, or t
  misc_feature (895)..(895): n is a, c, g, or t
  misc_feature (916)..(916): n is a, c, g, or t
  misc_feature (928)..(928): n is a, c, g, or t
  misc_feature (946)..(946): n is a, c, g, or t
  misc_feature (957)..(957): n is a, c, g, or t
  misc_feature (972)..(972): n is a, c, g, or t
  misc_feature (976)..(976): n is a, c, g, or t
  misc_feature (978)..(978): n is a, c, g, or t
  misc_feature (986)..(986): n is a, c, g, or t
  misc_feature (991)..(991): n is a, c, g, or t
  misc_feature (996)..(996): n is a, c, g, or t
  misc_feature (1001)..(1001): n is a, c, g, or t
  misc_feature (1021)..(1021): n is a, c, g, or t
  misc_feature (1039)..(1039): n is a, c, g, or t
  misc_feature (1062)..(1063): n is a, c, g, or t
  misc_feature (1069)..(1069): n is a, c, g, or t
  misc_feature (1071)..(1071): n is a, c, g, or t
  misc_feature (1073)..(1073): n is a, c, g, or t
  misc_feature (1080)..(1080): n is a, c, g, or t
  misc_feature (1091)..(1091): n is a, c, g, or t
  misc_feature (1095)..(1095): n is a, c, g, or t
  misc_feature (1097)..(1097): n is a, c, g, or t
  misc_feature (1104)..(1104): n is a, c, g, or t
  misc_feature (1109)..(1109): n is a, c, g, or t
  misc_feature (1115)..(1115): n is a, c, g, or t
  misc_feature (1120)..(1120): n is a, c, g, or t
  misc_feature (1126)..(1126): n is a, c, g, or t
  misc_feature (1174)..(1175): n is a, c, g, or t
  misc_feature (1177)..(1177): n is a, c, g, or t
  misc_feature (1180)..(1180): n is a, c, g, or t
  misc_feature (1187)..(1187): n is a, c, g, or t
  misc_feature (1191)..(1191): n is a, c, g, or t
  misc_feature (1197)..(1197): n is a, c, g, or t
  misc_feature (1211)..(1211): n is a, c, g, or t
  misc_feature (1222)..(1222): n is a, c, g, or t
  misc_feature (1224)..(1224): n is a, c, g, or t
  misc_feature (1234)..(1234): n is a, c, g, or t
  misc_feature (1239)..(1239): n is a, c, g, or t
  misc_feature (1244)..(1244): n is a, c, g, or t
  misc_feature (1255)..(1257): n is a, c, g, or t
  misc_feature (1260)..(1260): n is a, c, g, or t
  misc_feature (1266)..(1266): n is a, c, g, or t
  misc_feature (1269)..(1269): n is a, c, g, or t
gatagagaaaattactatgagaggatcgcatcaccatcaccatcacggatcctatttaggtgacactatagaatcgtcgacccacgcgtccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccanaatacatgtgcaatgctgacancttttaatgagattgacatgagtaacatccagganatgagggctcggcacaaagangcttttttgaanaaacataacctcaactangcttcatgtcngcatttgtgaaggcntcancntttgcctngcagnaacancctgnttgtaatgcagtgattgacnacccaccaaagaggtggngtaaagggataaattgacttcanngttgcngngnccccccncggggtctggnggtncngtcctcnggaangggaanctttnaatttnccaaaatgaacggaccctccctgactgggaaaaaaggcccaaaaaganntnccnttaaaantgangggggnacttcccataaaanggaggcttttngnccccctttgnaaccnataanacccccccaannnccnccgggnaangggccctt

SEQ ID NO: 135 - DNA, 1018 bp, Homo sapiens
  misc_feature (832)..(832): n is a, c, g, or t
  misc_feature (836)..(836): n is a, c, g, or t
  misc_feature (840)..(840): n is a, c, g, or t
  misc_feature (859)..(859): n is a, c, g, or t
  misc_feature (865)..(865): n is a, c, g, or t
  misc_feature (871)..(871): n is a, c, g, or t
  misc_feature (877)..(877): n is a, c, g, or t
  misc_feature (882)..(882): n is a, c, g, or t
  misc_feature (894)..(894): n is a, c, g, or t
  misc_feature (899)..(899): n is a, c, g, or t
  misc_feature (903)..(904): n is a, c, g, or t
  misc_feature (920)..(920): n is a, c, g, or t
  misc_feature (935)..(935): n is a, c, g, or t
  misc_feature (945)..(945): n is a, c, g, or t
  misc_feature (949)..(949): n is a, c, g, or t
  misc_feature (953)..(953): n is a, c, g, or t
  misc_feature (961)..(962): n is a, c, g, or t
  misc_feature (967)..(968): n is a, c, g, or t
  misc_feature (973)..(973): n is a, c, g, or t
  misc_feature (982)..(982): n is a, c, g, or t
  misc_feature (987)..(987): n is a, c, g, or t
  misc_feature (990)..(990): n is a, c, g, or t
  misc_feature (992)..(992): n is a, c, g, or t
  misc_feature (994)..(994): n is a, c, g, or t
  misc_feature (1000)..(1001): n is a, c, g, or t
  misc_feature (1005)..(1005): n is a, c, g, or t
tagagaaattactatgagaggatcgcatcaccatcaccatcacggatcctatttaggtgacactatagaatcgtcgacccacgcgtccgagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctganggantcancccgggcaccaaccctgcnaacggntgcacnttcggnggggnctggccgcgganctganttanncagcttcagtgatggngcttctcttccccanaagggccccnaggnggcnggcctganntcccnntgaanttccctccnaacgnggnangnagggtnngaanccaaccctttctg

SEQ ID NO: 136 - DNA, 865 bp, Homo sapiens
  misc_feature (1)..(2): n is a, c, g, or t
  misc_feature (857)..(858): n is a, c, g, or t
nnttatagagagaatactatgagaggatgcatcccatcaccatcacggatcctatttaggtgacactatagaatcgtcgactctggaccttggctgtcactcagttacaacgtgtgatgccattagtgtattggagaaagaacatgactactcagatgaccgttttgattttattcagtcacatatccggaagttttgtttacagtatggtgcggcacttatttacactctcctgagagatcacaccaaaatacacttatgatataaatacttccttcataaactatatggatttccctatacgattcctgctgttgttgtggaaaaggatgcagtatttattccagcacggtgggataatgataagaaaataggactattacatgaagattttcaaacattaaaggcagaagataattttgaagacatcataactaacccacctgttcgaacgtttgtacatgagaaggatattatggcggaagatgatcaggtgtttcttatgaagctacagtcccttttagcagagcaaccaccaactgcagctggaacgccggtggatgcctcaccaagagtcccaggaggctccccacgaacaccagatatatctgtatcatctaatgttgccaacgagtcacccattcctgctgggtcagacaacattgatccatacatggaagctggagctacgagtgaaggcgttctggcagatttcttcaacacgtgtgtgagtaacaagactggctctccacgaggcactggtgtgagtggtgctagtcctgcacgtggagctggaggtgaagcactggtttacaccatccacaaaagtcaggcaaaagctgtcgtagatgtctgcnnactagac

SEQ ID NO: 137 - DNA, 844 bp, Homo sapiens
  misc_feature (569)..(569): n is a, c, g, or t
  misc_feature (702)..(702): n is a, c, g, or t
  misc_feature (790)..(790): n is a, c, g, or t
  misc_feature (793)..(793): n is a, c, g, or t
  misc_feature (800)..(800): n is a, c, g, or t
ataagagatactatgagaggacgcatcaccatcaccatcacggatcctatttaggtgacactatagaatcgtcgactctggaccttggctgtcactcagttaaggtggtgtgtgtgggcatgaattatgtggaccactgcaaggaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaaggcagaggacctgatagcctgngtctcccagtttgttaccttttacccaggggatgtcatcctaactgggacccccccaggtgtcggtgtattcaggaaacctcctgtctttctcaagaagggggatgaagtccagtgtgagattgaagaactangtgtcaatcatcacaaggtggtgtgatggctcctgcacaggccctgcacataggatgagggcatctgctcccactcagcctagcccanggnaaagccnagtgacaggtgtggacaggtgcaagccctgcaagcccgctcttt

SEQ ID NO: 138 - DNA, 740 bp, Homo sapiens
tactatgagaggtcgcatcaccatcaccatcacggatcctatttaggtgacactatagaatcgtcgactctggaccttggctgtcactcagttgggggcaaatctctgctgtcgtcagcatctgccacagtaggtcatggattgacggcagtcaaggaaaaagcaggagccactctacggattcatggtgtaaattctggatcttctgaaggagcccaaccaaatactgaaagcggagtccctgaaataacagatgcagccacagatcagggccctgcagaaagcccacccacctccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggtacttctgcactactcgtttgaaatggcatgcttagtcatgtgttgcttaaacatgaaagaaactggaaaatctgccattaaaagatctcatttttt

SEQ ID NO: 139 - DNA, 818 bp, Homo sapiens
  misc_feature (746)..(746): n is a, c, g, or t
  misc_feature (756)..(756): n is a, c, g, or t
  misc_feature (772)..(773): n is a, c, g, or t
atactatgagaggtcgcatcccatcaccatcacggatcctatttaggtgacactatagaatcgtcgactctggaccttggctgtcactcagttaaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttncaatctgctnggaggcattaatctanngatcagcttgcacagagcacaaaaacaccaaaaaatttcaaacag

SEQ ID NO: 140 - DNA, 844 bp, Homo sapiens
  misc_feature (694)..(695): n is a, c, g, or t
  misc_feature (734)..(734): n is a, c, g, or t
  misc_feature (744)..(744): n is a, c, g, or t
  misc_feature (834)..(834): n is a, c, g, or t
atagagagatactatgagaggacgcatcaccatcaccatcacggatcctatttaggtgacactatagaatcgtcgactctggaccttggctgtcactcagttaggaaaggagtgaaggaacccacgaagcttttaaaaaaacattctacccaagtctacctgggaccttccaagaagacgtctgtgtcaaacgcaggccaatggctttatgaagaaaaaccacataaaatggatttgctccatgaaaatggtcctcgtcctggtcttcatgaaaatggaatttcggacatcgatgaagagttcatcttgaaacagtttgacattgactatgagaccaaaccaagccatgatgcgctccacacgatgaagctaaatcaggttcctctggagctacagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacagttccttgagaatatgtatatcgggaaggaaatgtaacgtgcatgtaataagactcctatannacgaaactcagcatagaagaatcgtaagagaatgattangcagattttnatactacgtacttggctatttctctgtctcctttttaagattaacagagtttatgatgagtgtccactgtggatgttcactttgacttgncacatctgta

SEQ ID NO: 141 - DNA, 1133 bp, Homo sapiens
  misc_feature (843)..(843): n is a, c, g, or t
  misc_feature (915)..(915): n is a, c, g, or t
  misc_feature (931)..(931): n is a, c, g, or t
  misc_feature (942)..(942): n is a, c, g, or t
  misc_feature (947)..(947): n is a, c, g, or t
  misc_feature (957)..(957): n is a, c, g, or t
  misc_feature (965)..(965): n is a, c, g, or t
  misc_feature (977)..(977): n is a, c, g, or t
  misc_feature (993)..(993): n is a, c, g, or t
  misc_feature (1001)..(1001): n is a, c, g, or t
  misc_feature (1009)..(1009): n is a, c, g, or t
  misc_feature (1020)..(1020): n is a, c, g, or t
  misc_feature (1041)..(1041): n is a, c, g, or t
  misc_feature (1054)..(1054): n is a, c, g, or t
  misc_feature (1061)..(1061): n is a, c, g, or t
  misc_feature (1064)..(1064): n is a, c, g, or t
  misc_feature (1066)..(1066): n is a, c, g, or t
  misc_feature (1071)..(1071): n is a, c, g, or t
  misc_feature (1073)..(1075): n is a, c, g, or t
  misc_feature (1085)..(1085): n is a, c, g, or t
  misc_feature (1089)..(1089): n is a, c, g, or t
  misc_feature (1094)..(1094): n is a, c, g, or t
  misc_feature (1096)..(1096): n is a, c, g, or t
  misc_feature (1102)..(1102): n is a, c, g, or t
  misc_feature (1105)..(1105): n is a, c, g, or t
  misc_feature (1111)..(1112): n is a, c, g, or t
  misc_feature (1123)..(1123): n is a, c, g, or t
tagagaaattactatgagaggatcgcatcaccatcaccatcacggatcctatttaggtgacactatagaatcgtcgacccacgcgtccgggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcccacccctctgcctgcccccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggnccccgctgccctgacaccccctgagcccccatctgctgaaccctgactggtaaacaactgctgtcaaaaaanggctgggcttgggaangggaagtggangccangtgtccccanacctctanccttgcccctancacctctttttgtgancctctcangggggcanccctcccatgntggggtcgggccactctcccnaaagtcttgactnatgatgnccngnaaccngnnnggccctttcnaaangaacncngaaatnggnagggcnntgttccctggnccctcaaaat

SEQ ID NO: 142 - DNA, 1323 bp, Homo sapiens
attctgacttacctaaaaataggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacagtcgacccacgcgtccggtccccaagcttggtggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaagcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgatggcaaaggacgcctcatgcctgggcaggaccctgagaaaaccataggagacatgttccaaaaccaagaccgcaaccaggacggcaagatcacagtccaacgagctcaagctgaagtccaatgacgaccacgagcgggtccacgacgacctctgaagggcatggaccccgtcccagccctgaaaaccaacgcccccctgcaagggggcacctcgcgccacaaccgacctaccgcacaaacccctcacccaccgtcatctgtcatgcccacccccaccaccacaccaccacaacccacccccctcatcctaccacccaacaacccaataccacaccccaccccacccccataaccgcaaccgccccaccactcttcgcccacctcacccccaccaacccccaccactcacatctcgatcgcacaaccaccacaccaacccccctttgcccataacacaccccccccacccacccccccatcccccctcccctaacaccccccaaccccccatgcccccttaccaccaccaactgcaaaaataacacacgtccagcatctcatccacacctaaaaccctataacatcatcacactaccactaaaaactctcaaaccctttcgtcacccagtataactcccaacacacacccagcatctccatcgctcccactctccccacaccccacacccctcacac

SEQ ID NO: 143 - DNA, 1198 bp, Homo sapiens
  misc_feature (4)..(4): n is a, c, g, or t
  misc_feature (16)..(16): n is a, c, g, or t
  misc_feature (180)..(180): n is a, c, g, or t
  misc_feature (627)..(627): n is a, c, g, or t
  misc_feature (748)..(748): n is a, c, g, or t
  misc_feature (801)..(801): n is a, c, g, or t
  misc_feature (803)..(803): n is a, c, g, or t
  misc_feature (884)..(884): n is a, c, g, or t
  misc_feature (896)..(896): n is a, c, g, or t
  misc_feature (959)..(959): n is a, c, g, or t
  misc_feature (961)..(961): n is a, c, g, or t
  misc_feature (995)..(995): n is a, c, g, or t
  misc_feature (1006)..(1006): n is a, c, g, or t
  misc_feature (1015)..(1015): n is a, c, g, or t
  misc_feature (1044)..(1044): n is a, c, g, or t
  misc_feature (1050)..(1050): n is a, c, g, or t
  misc_feature (1055)..(1055): n is a, c, g, or t
  misc_feature (1057)..(1057): n is a, c, g, or t
  misc_feature (1073)..(1074): n is a, c, g, or t
  misc_feature (1080)..(1080): n is a, c, g, or t
  misc_feature (1083)..(1084): n is a, c, g, or t
  misc_feature (1089)..(1089): n is a, c, g, or t
  misc_feature (1093)..(1093): n is a, c, g, or t
  misc_feature (1104)..(1104): n is a, c, g, or t
  misc_feature (1106)..(1106): n is a, c, g, or t
  misc_feature (1114)..(1114): n is a, c, g, or t
  misc_feature (1126)..(1126): n is a, c, g, or t
  misc_feature (1140)..(1140): n is a, c, g, or t
  misc_feature (1143)..(1143): n is a, c, g, or t
  misc_feature (1156)..(1156): n is a, c, g, or t
  misc_feature (1162)..(1162): n is a, c, g, or t
  misc_feature (1181)..(1182): n is a, c, g, or t
  misc_feature (1188)..(1188): n is a, c, g, or t
  misc_feature (1191)..(1191): n is a, c, g, or t
  misc_feature (1195)..(1196): n is a, c, g, or t
gaantagagagattanctatgagaggatcgcatcaccatcaccatcacggatcctatttaggtgacactatagaatcgtcgacccacgcgtccgcggacgcgtgggccaccatctctagttcttcttccactaaaggaataaagaggaaagctacagaaattagcactgcagtggttcanaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcanagtatccagcgtgagttagatgaagaggacaattctagttccagtgaagaggatcgggaatcaactgcacagaagcgaattgaagagtggaaacagcagcagctggttagtggcatggcanagagaaatgctaattttgaagcccttcctgaggattggagagcaaggctgaananaaggaaaatggctccaaacacatagtttttaagtttttaaaacttttttgtattattgtttgttttgggttcagttcaaangtcttaaccagnttttattgtcaaataaactataaatgttatggggggaaatctttataaattttcctgggcaanantgtatgcatacaaagtttttcacttttgggaaangtaatttttcngtttttgcnaaagggatgaggtgaatggaaatgctttnaaccangctgncntttattcccaaatggnnaaattnacnngttangggnattaaccccancntcttgganaaaatggggctnagaaaaaaaacctntgnaaggaatccctgnaaaaantgaaaattaatttcccccnnaaaaantgnaatnnaa

SEQ ID NO: 144 - DNA, 1229 bp, Homo sapiens
ggaacgcttatactgaattacctataaaaaggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccctcaccatcacggtcgacccacgcgtccggctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcgggggcaactactggacgctggactcccgctgcctgaacatgtttgagaacggcgactaccggcgacggaagaggcagcccctcccgggccccccagtgccacaaccgcgcagctacacaggcccccaccaaccacgacgtgaaccgcgaacgagcaatcccagcagccgatcgaccacagtctgccctaccggcctccccgtgcacccgaccccaaagtccacagaacaacaccattaaccgcccaaaatcacgcaagcaaagagcaccgcccaacccccacccagagcgacaacagactggagcaatcccacagccccctccgaacccgcgccagatgcccgcaaagcgaccagaccagaaccatcacaaacgtacaccaccctcaaccacgctgcgacacgacccgcaagcccggcccgcagcgcggccctacccacagcctacaatcggacgaccacagcctgcgccgagcctatcagacaggccccccccacccaagcacagcaaccaaccacccaagaccactacacagcatgaccacagagcacgattaccaaagagcccacatcgagacgacagcataaccggcaacactatccacaaagtcccggcaccgtgacccgacacataaactggggccgcccctactccgacgagaccaccagttccacccctacgcagcccccccaagaacaacaggctcaacgagcaccaagcttgagcaccacgtccccccgccaggcgatcataacacaacgatcacgcg

SEQ ID NO: 145 - DNA, 1206 bp, Homo sapiens
  misc_feature (2)..(2): n is a, c, g, or t
  misc_feature (861)..(861): n is a, c, g, or t
  misc_feature (884)..(884): n is a, c, g, or t
  misc_feature (902)..(902): n is a, c, g, or t
  misc_feature (915)..(915): n is a, c, g, or t
  misc_feature (942)..(942): n is a, c, g, or t
  misc_feature (945)..(945): n is a, c, g, or t
  misc_feature (986)..(986): n is a, c, g, or t
  misc_feature (1006)..(1006): n is a, c, g, or t
  misc_feature (1029)..(1029): n is a, c, g, or t
  misc_feature (1048)..(1048): n is a, c, g, or t
  misc_feature (1081)..(1083): n is a, c, g, or t
  misc_feature (1103)..(1103): n is a, c, g, or t
  misc_feature (1105)..(1106): n is a, c, g, or t
  misc_feature (1110)..(1110): n is a, c, g, or t
  misc_feature (1113)..(1113): n is a, c, g, or t
  misc_feature (1124)..(1126): n is a, c, g, or t
  misc_feature (1129)..(1129): n is a, c, g, or t
  misc_feature (1131)..(1131): n is a, c, g, or t
  misc_feature (1133)..(1133): n is a, c, g, or t
  misc_feature (1138)..(1138): n is a, c, g, or t
  misc_feature (1145)..(1145): n is a, c, g, or t
  misc_feature (1150)..(1150): n is a, c, g, or t
  misc_feature (1169)..(1169): n is a, c, g, or t
  misc_feature (1174)..(1175): n is a, c, g, or t
  misc_feature (1177)..(1177): n is a, c, g, or t
  misc_feature (1188)..(1188): n is a, c, g, or t
cnaatagagagattactatgagaggatcgcatcaccatcaccatcacggatcctatttaggtgacactatagaatcgtcgacccacgcgtccgataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccaaaagatgggctgtccgccgagctgcttgaagctcaggctgaggaggaaccagcaagcacagagggcctanatactgggacggaagctgagggnctggacagccaggcccanatctctaccacanaataacaccctggggctgtgacaaggnccnatgatgaaatttcatgaggcccaaatgtgggcaggcagccngggctgcactatgcggtcangattcttgctgctttggtgggantgaaggcctcatgggtggngaaaaggggcccatgggcccttgggggaagaannnttttggccgggaaccctcangnncagnggntgggccctgcnnnggncncnggggnttcccanaaagnaaacagggtttggtcttantccanntnaaaaaaaattnaaaaaaaaagggtttctt

SEQ ID NO: 146 - DNA, 1028 bp, Homo sapiens
  misc_feature (613)..(613): n is a, c, g, or t
  misc_feature (746)..(746): n is a, c, g, or t
  misc_feature (827)..(827): n is a, c, g, or t
  misc_feature (835)..(835): n is a, c, g, or t
  misc_feature (857)..(857): n is a, c, g, or t
  misc_feature (865)..(865): n is a, c, g, or t
  misc_feature (871)..(871): n is a, c, g, or t
  misc_feature (879)..(879): n is a, c, g, or t
  misc_feature (901)..(901): n is a, c, g, or t
  misc_feature (908)..(908): n is a, c, g, or t
  misc_feature (917)..(917): n is a, c, g, or t
  misc_feature (936)..(936): n is a, c, g, or t
  misc_feature (939)..(939): n is a, c, g, or t
  misc_feature (944)..(944): n is a, c, g, or t
  misc_feature (948)..(948): n is a, c, g, or t
  misc_feature (959)..(959): n is a, c, g, or t
  misc_feature (964)..(964): n is a, c, g, or t
  misc_feature (966)..(966): n is a, c, g, or t
  misc_feature (969)..(969): n is a, c, g, or t
  misc_feature (975)..(975): n is a, c, g, or t
  misc_feature (984)..(984): n is a, c, g, or t
  misc_feature (987)..(987): n is a, c, g, or t
  misc_feature (991)..(991): n is a, c, g, or t
  misc_feature (993)..(994): n is a, c, g, or t
  misc_feature (998)..(1000): n is a, c, g, or t
  misc_feature (1008)..(1008): n is a, c, g, or t
  misc_feature (1020)..(1020): n is a, c, g, or t
  misc_feature (1026)..(1026): n is a, c, g, or t
tagagaaattactatgagaggatcgcatcaccatcaccatcacggatcctatttaggtgacactatagaatcgtcgacccacgcgtccggctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcggnaaggctgcctaccgcacatccccacggttgaaggacaagaagatggatgcccatcctcctcgcctctttgcctgctccaacaagattggacgttttgtgatcgaagaggttcctggtgagctcatgcaggaanacctggcaacggatgacgtcatgcttctggacacctgggaccaggtctttgtttgggttggaaaggattctcaagaagaanaaaagacngaagccttgacttctgctaagnggtacatngaaaanggacccanccaatcgggaatcgggggaacncccatcncccgggggngaaaaaaagggtttttganccntcccntccnttttggggggnttggntnccnttgggntgggaaaanaanaatnanngggnnntggggganccccctttgganaagggncc

SEQ ID NO: 147 - DNA, 489 bp, Homo sapiens
atggttctgagtccggcagataaaaccaatgttaaagcagcatggggtaaagttggtgcacatgccggtgaatatggtgccgaagcactggaacgtatgtttctgagctttccgaccaccaaaacctattttccgcattttgatctgagccatggtagcgcacaggttaaaggtcatggtaaaaaagttgcagatgcactgaccaatgcagttgcacatgttgatgatatgccgaatgccctgagcgcactgagcgatctgcacgcacataaactgcgtgttgatccggttaactttaaactgctgagccattgtctgctggttaccctggcagcacatctgcctgcagaatttacaccggcagttcatgcaagcctggataaatttctggcaagcgttagcaccgttctgaccagcaaatatcgtagatcttaagcggccgcggtacctggagcacaagactggcctcatgggccttccgctcactgc

SEQ ID NO: 148 - DNA, 633 bp, Homo sapiens
aatataaaaaattatttgctttgtgagcggatacaattataatagattaattgtgagcggataacaatttcacacagaattcattaaagaggagaaattaactatgagaggatcgcatcaccatcaccatcacggatcctatttaggtgacactatagaatcgtcgacccacgcgtccgcacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagc

SEQ ID NO: 149 - DNA, 590 bp, Homo sapiens
  misc_feature (433)..(433): n is a, c, g, or t
  misc_feature (501)..(501): n is a, c, g, or t
  misc_feature (538)..(539): n is a, c, g, or t
  misc_feature (550)..(550): n is a, c, g, or t
  misc_feature (552)..(553): n is a, c, g, or t
  misc_feature (556)..(556): n is a, c, g, or t
  misc_feature (563)..(564): n is a, c, g, or t
  misc_feature (568)..(569): n is a, c, g, or t
  misc_feature (571)..(571): n is a, c, g, or t
  misc_feature (581)..(581): n is a, c, g, or t
  misc_feature (590)..(590): n is a, c, g, or t
tagagagattactatgagaggatcgcatcaccatcaccatcacggatcctatttaggtgacactatagaatcgtcgacccacgcgtccgcgggacgcgcttggccttgcccgcgcccgctcgcctcgtctcgcccggcctccccgcgtcgcctcgtcgcctgttccgcgccaggcatggcccccagcactgtggccgtggagctgctcagccccaaagagaaaaaccgactgcggaagccggtggtggagaagatgcgccgcgaccgcatcaacagcagcatcgagcagctgaagctgctgctggagcaggagttcgcgcggcaccagcccaactccaagctggagaaggccgacatcctggagatggctgtcagctacctgaagcacagcaaagccttcgtcgccgccgccggccccaagagcctgcaccangactacagcgaaggctactcgtggtgcctgcaggaggccgtgcagttcctgacgctccacgccgccancgacacgcaaatgaagctgctgtaccacttccagtgnnctccggccgcncnngcngtgcccnncaannancccaaggcancaggcgccn

SEQ ID NO: 150 - DNA, 978 bp, Homo sapiens
  misc_feature (1)..(1): n is a, c, g, or t
  misc_feature (260)..(260): n is a, c, g, or t
  misc_feature (636)..(636): n is a, c, g, or t
  misc_feature (789)..(789): n is a, c, g, or t
  misc_feature (834)..(834): n is a, c, g, or t
  misc_feature (867)..(867): n is a, c, g, or t
  misc_feature (869)..(869): n is a, c, g, or t
  misc_feature (896)..(897): n is a, c, g, or t
  misc_feature (912)..(912): n is a, c, g, or t
  misc_feature (919)..(920): n is a, c, g, or t
  misc_feature (928)..(928): n is a, c, g, or t
  misc_feature (932)..(934): n is a, c, g, or t
  misc_feature (938)..(938): n is a, c, g, or t
  misc_feature (942)..(942): n is a, c, g, or t
  misc_feature (950)..(950): n is a, c, g, or t
  misc_feature (955)..(955): n is a, c, g, or t
  misc_feature (965)..(965): n is a, c, g, or t
  misc_feature (970)..(971): n is a, c, g, or t
  misc_feature (978)..(978): n is a, c, g, or t
naatagagaaattactatgagaggatcgcatcaccatcaccatcacggatcctatttaggtgacactatagaatcgtcgacccacgcgtccgtgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcntccctccagcaggccagactgaagatgcagagcccatttcagaacctgagaaagtagagactgcaggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaantggaaactgttctcctccccagccccactccctgttccctacccatataggccctaaatttgggaaaaatcactattaatttctgaatcctttgcctgtgggtaggaaagaaaatggctgccaagtggctgatgggtcccggtgatggcaaanggtatcaggttgccggggagtttccactccttctctggtgattgnttccttccctccctttcctctcccaaccatggnantgaacatcccttttcaagggccagtgnntggcaaagccttcantttaccnnggtttggntttnnnaagngccntatctggngcttntttcctcccntctgnnggctttn

SEQ ID NO: 151 - DNA, 959 bp, Homo sapiens
gaggatcgcatcaccatcaccatcacggatcctatttaggtgacactatagaatcgtcgacccacgcgtccgggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccga

SEQ ID NO: 152 - DNA, 1067 bp, Homo sapiens
  misc_feature (786)..(786): n is a, c, g, or t
  misc_feature (804)..(804): n is a, c, g, or t
  misc_feature (836)..(836): n is a, c, g, or t
  misc_feature (847)..(847): n is a, c, g, or t
  misc_feature (867)..(867): n is a, c, g, or t
  misc_feature (877)..(877): n is a, c, g, or t
  misc_feature (879)..(879): n is a, c, g, or t
  misc_feature (891)..(891): n is a, c, g, or t
  misc_feature (906)..(906): n is a, c, g, or t
  misc_feature (942)..(942): n is a, c, g, or t
  misc_feature (946)..(946): n is a, c, g, or t
  misc_feature (955)..(955): n is a, c, g, or t
  misc_feature (957)..(958): n is a, c, g, or t
  misc_feature (962)..(962): n is a, c, g, or t
  misc_feature (971)..(971): n is a, c, g, or t
  misc_feature (976)..(976): n is a, c, g, or t
  misc_feature (982)..(982): n is a, c, g, or t
  misc_feature (984)..(984): n is a, c, g, or t
  misc_feature (988)..(988): n is a, c, g, or t
  misc_feature (995)..(995): n is a, c, g, or t
  misc_feature (1004)..(1004): n is a, c, g, or t
  misc_feature (1007)..(1007): n is a, c, g, or t
  misc_feature (1014)..(1014): n is a, c, g, or t
  misc_feature (1016)..(1016): n is a, c, g, or t
  misc_feature (1020)..(1020): n is a, c, g, or t
  misc_feature (1025)..(1025): n is a, c, g, or t
  misc_feature (1028)..(1028): n is a, c, g, or t
  misc_feature (1032)..(1032): n is a, c, g, or t
  misc_feature (1051)..(1051): n is a, c, g, or t
  misc_feature (1064)..(1064): n is a, c, g, or t
tagagaaattactatgagaggatcgcatcaccatcaccatcacggatcctatttaggtgacactatagaatcgtcgacccacgcgtccgggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccaccaccacccctgcctggcctggctaccanccccccatttcagctaancaagccagggctgtggagtaccctgcatgganatgcctggggncccaaagcgcaagggttcancaccccccanancgccaggagcancggcactcgctgccntcacccatatccatacccagctccagcgtaaaccgngcanccccctggncnncggntggtccggntgctnccccangnccangcccccnccccccaanaanaaaaaancntggntggcntgnctgncacccgtcccccggaaatnaccttaaaaaaanaaa

SEQ ID NO: 153 - DNA, 1244 bp, Homo sapiens
  misc_feature (2)..(2): n is a, c, g, or t
  misc_feature (949)..(949): n is a, c, g, or t
  misc_feature (960)..(960): n is a, c, g, or t
  misc_feature (982)..(982): n is a, c, g, or t
  misc_feature (1003)..(1003): n is a, c, g, or t
  misc_feature (1026)..(1026): n is a, c, g, or t
  misc_feature (1036)..(1036): n is a, c, g, or t
  misc_feature (1043)..(1043): n is a, c, g, or t
  misc_feature (1053)..(1053): n is a, c, g, or t
  misc_feature (1071)..(1071): n is a, c, g, or t
  misc_feature (1080)..(1082): n is a, c, g, or t
  misc_feature (1086)..(1087): n is a, c, g, or t
  misc_feature (1091)..(1091): n is a, c, g, or t
  misc_feature (1095)..(1095): n is a, c, g, or t
  misc_feature (1101)..(1101): n is a, c, g, or t
  misc_feature (1103)..(1103): n is a, c, g, or t
  misc_feature (1113)..(1113): n is a, c, g, or t
  misc_feature (1116)..(1116): n is a, c, g, or t
  misc_feature (1119)..(1119): n is a, c, g, or t
  misc_feature (1125)..(1125): n is a, c, g, or t
  misc_feature (1139)..(1139): n is a, c, g, or t
  misc_feature (1141)..(1142): n is a, c, g, or t
  misc_feature (1148)..(1149): n is a, c, g, or t
  misc_feature (1160)..(1160): n is a, c, g, or t
  misc_feature (1162)..(1162): n is a, c, g, or t
  misc_feature (1188)..(1188): n is a, c, g, or t
  misc_feature (1195)..(1195): n is a, c, g, or t
  misc_feature (1212)..(1212): n is a, c, g, or t
  misc_feature (1228)..(1228): n is a, c, g, or t
  misc_feature (1230)..(1230): n is a, c, g, or t
  misc_feature (1236)..(1236): n is a, c, g, or t
antagagagattactatgagaggatcgcatcaccatcaccatcacggatcctatttaggtgacactatagaatcgtcgacccacgcgtccgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcagaactgatgaattagaaaaacncctaccgaacnttggatagcctggagcaaaccnttaacagctcgaaatacatcngtgaaatgagtcccaagccctanttgaacctcntgttctnccacaaaatnctgttgcagttcctcccnatagcccannngccnncccnaccntgctantncggagaaggnccntgnccaaancccctagtcaaacntnncttccnnaggaactgggntncggaaaagaaaaaccccctgctttcnaatcgcnaaacccttaggaagggnctggaattattttttntncggggntttttttt

SEQ ID NO: 154 - DNA, 1012 bp, Homo sapiens
  misc_feature (833)..(833): n is a, c, g, or t
  misc_feature (840)..(840): n is a, c, g, or t
  misc_feature (847)..(847): n is a, c, g, or t
  misc_feature (856)..(856): n is a, c, g, or t
  misc_feature (861)..(861): n is a, c, g, or t
  misc_feature (880)..(880): n is a, c, g, or t
  misc_feature (883)..(883): n is a, c, g, or t
  misc_feature (886)..(886): n is a, c, g, or t
  misc_feature (898)..(898): n is a, c, g, or t
  misc_feature (920)..(920): n is a, c, g, or t
  misc_feature (935)..(935): n is a, c, g, or t
  misc_feature (941)..(941): n is a, c, g, or t
  misc_feature (950)..(950): n is a, c, g, or t
  misc_feature (955)..(955): n is a, c, g, or t
  misc_feature (966)..(966): n is a, c, g, or t
  misc_feature (970)..(971): n is a, c, g, or t
  misc_feature (976)..(977): n is a, c, g, or t
  misc_feature (979)..(980): n is a, c, g, or t
  misc_feature (986)..(987): n is a, c, g, or t
  misc_feature (991)..(992): n is a, c, g, or t
  misc_feature (1000)..(1001): n is a, c, g, or t
  misc_feature (1003)..(1003): n is a, c, g, or t
  misc_feature (1010)..(1010): n is a, c, g, or t
taatagagaaattactatgagaggatcgcatcaccatcaccatcacggatcctatttaggtgacactatagaatcgtcgacccacgcgtccggctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgctccctatantgagtcntattaancttaattanctgancttggactcctgttgatanatncantaatgacctcanaactccatctggatttgttcanaacgctcggttgccnccgggngtttttttnttggngaaaatccaanctannttggnnannattttnngganntaaggaanntnaaatggnaa

SEQ ID NO: 155 - DNA, 941 bp, Homo sapiens
catcaccatcaccatcacggatcctatttaggtgacactatagaatcgtcgacccacgcgtccgatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaagaaaaaaagctagagaccctttttgcaaacatttg

SEQ ID NO: 156 - DNA, 958 bp, Homo sapiens
tatgagaggatcgcatcaccatcaccatcacggatcctatttaggtgacactatagaatcgtcgacccacgcgtccgcccacgcgtccgcccacgcgtccggcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctggggctcctgaaggcttattccatccggaccgcatccgccagtcgcaggagtgcccgcgactgagccgcctcccaccactccactcctccagccaccacccacaatcacaagaagattcccacccctgc

SEQ ID NO: 157 - DNA, 455 bp, Homo sapiens
  misc_feature (454)..(455): n is a, c, g, or t
atagagagatactatgagaggtcgcatcaccatcaccatcacggatcctatttaggtgacactatagaatcgtcgactctggaccttggctgtcactcagtttataaacaaggaagtaaagggggccccttgtgctctcagaactccaagcatgaaacgattttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataaccccggatcgatggtactttttgaaaatgctttattgcaaaagagtggctagggttttacaagggctatgaagaaacatattaaggttaataaagctttttattgagtgtttann

SEQ ID NO: 158 - DNA, 951 bp, Homo sapiens
  misc_feature (1)..(3): n is a, c, g, or t
  misc_feature (721)..(721): n is a, c, g, or t
  misc_feature (770)..(771): n is a, c, g, or t
  misc_feature (775)..(775): n is a, c, g, or t
  misc_feature (778)..(778): n is a, c, g, or t
  misc_feature (781)..(781): n is a, c, g, or t
  misc_feature (786)..(786): n is a, c, g, or t
  misc_feature (789)..(790): n is a, c, g, or t
  misc_feature (809)..(809): n is a, c, g, or t
  misc_feature (825)..(826): n is a, c, g, or t
  misc_feature (859)..(860): n is a, c, g, or t
  misc_feature (862)..(866): n is a, c, g, or t
  misc_feature (868)..(868): n is a, c, g, or t
  misc_feature (874)..(874): n is a, c, g, or t
  misc_feature (897)..(897): n is a, c, g, or t
  misc_feature (903)..(903): n is a, c, g, or t
  misc_feature (907)..(907): n is a, c, g, or t
  misc_feature (917)..(917): n is a, c, g, or t
  misc_feature (927)..(928): n is a, c, g, or t
  misc_feature (936)..(936): n is a, c, g, or t
  misc_feature (939)..(939): n is a, c, g, or t
nnngggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgaaaagacgcagctcattcaacaggtggagcagctaagcaagaggtgtcccggctggcccgcaaaaaaacgcctagaggtcaagtgcgaaaaactcgccaactccggctttcaggagagcggnttcatgaaaggaaacccccactactcacaagatttactggtaatcgtanncganctngancctcnccnnaagaaatggccagaagtgngttctcggaccaaaanncctaccttacaggccacaatacatacaaccaannannnnnanacaaanagaaagacctcatgtctaaccantaaatnccangcaaaaacanatactatccnntaacctcnggntcccagtacata

SEQ ID NO: 159 - DNA, 509 bp, Homo sapiens
atgagcgttgatccgctgagcagcaaagcactgaaaattaaacgcgaactgagcgaaaatacaccgcatctgtctgatgaagcactgatgggtctgagcgttcgtgaactgaatcgtcatctgcgtggtctgagcgcagaagaagttacccgtctgaaacagcgtcgtcgtaccctgaaaaatcgtggttatgcagcaagctgtcgtgttaaacgtgtttgccagaaagaagaactgcagaaacagaaaagcgaactggaacgtgaagttgataaactggcacgtgaaaatgcagcaatgcgtctggaactggatgcactgcgtggtaaatgtgaagcactgcagggttttgcacgtagcgttgcagcagcacgtggtccggcaaccctggttgcaccggcaagcgttattaccattgttaaaagcacaccgggtagcggtagcggtccggcacatggtcctgatccggctcatggtccggcaagctgtagctaagcggccgcgagctc

SEQ ID NO: 160 - DNA, 1179 bp, Homo sapiens
  misc_feature (774)..(774): n is a, c, g, or t
  misc_feature (838)..(838): n is a, c, g, or t
  misc_feature (872)..(872): n is a, c, g, or t
  misc_feature (892)..(892): n is a, c, g, or t
  misc_feature (898)..(898): n is a, c, g, or t
  misc_feature (925)..(925): n is a, c, g, or t
  misc_feature (938)..(938): n is a, c, g, or t
  misc_feature (967)..(967): n is a, c, g, or t
  misc_feature (982)..(983): n is a, c, g, or t
  misc_feature (994)..(995): n is a, c, g, or t
  misc_feature (1002)..(1003): n is a, c, g, or t
  misc_feature (1012)..(1012): n is a, c, g, or t
  misc_feature (1021)..(1021): n is a, c, g, or t
  misc_feature (1062)..(1063): n is a, c, g, or t
  misc_feature (1076)..(1076): n is a, c, g, or t
  misc_feature (1092)..(1092): n is a, c, g, or t
  misc_feature (1094)..(1094): n is a, c, g, or t
  misc_feature (1096)..(1097): n is a, c, g, or t
  misc_feature (1121)..(1121): n is a, c, g, or t
  misc_feature (1129)..(1129): n is a, c, g, or t
  misc_feature (1131)..(1132): n is a, c, g, or t
  misc_feature (1138)..(1138): n is a, c, g, or t
  misc_feature (1144)..(1144): n is a, c, g, or t
  misc_feature (1146)..(1146): n is a, c, g, or t
  misc_feature (1150)..(1150): n is a, c, g, or t
  misc_feature (1158)..(1158): n is a, c, g, or t
  misc_feature (1171)..(1172): n is a, c, g, or t
tagagaaattactatgagaggatcgcatcaccatcaccatcacggatcctatttaggtgacactatagaatcgtcgacccacgcgtccgcgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgancaatgtggcccccccctgcattctccggaagaatcctccatcagcccgaaatggcggccatganactgatgcccaaaattcttgaactcaaccaacanctggtggacttgaaactganagtggnatgggctggaaaaaagaaagtgacttntacttcagcaaanttcgtgaaatcgagctcatctgccaggancatgaaagtgaaaanngccctgttatnncaggaannttggcatcntttatgccnaaaaagaaaggattcccaccccctggaggagaatgaaaatnnaaaaacctccacnaaaaaaaaccgggacnantnntggagggggggcgcctcccctaanagggaggncnnattaanctttantnaacngaaacttnggaaccccggttnnaaaaatc

SEQ ID NO: 161 - DNA, 1280 bp, Homo sapiens
  misc_feature (2)..(2): n is a, c, g, or t
  misc_feature (876)..(876): n is a, c, g, or t
  misc_feature (944)..(944): n is a, c, g, or t
  misc_feature (977)..(977): n is a, c, g, or t
  misc_feature (982)..(982): n is a, c, g, or t
  misc_feature (986)..(987): n is a, c, g, or t
  misc_feature (1006)..(1006): n is a, c, g, or t
  misc_feature (1027)..(1027): n is a, c, g, or t
  misc_feature (1048)..(1048): n is a, c, g, or t
  misc_feature (1058)..(1058): n is a, c, g, or t
  misc_feature (1087)..(1088): n is a, c, g, or t
  misc_feature (1096)..(1096): n is a, c, g, or t
  misc_feature (1098)..(1098): n is a, c, g, or t
  misc_feature (1111)..(1111): n is a, c, g, or t
  misc_feature (1117)..(1117): n is a, c, g, or t
  misc_feature (1124)..(1124): n is a, c, g, or t
  misc_feature (1133)..(1133): n is a, c, g, or t
  misc_feature (1136)..(1137): n is a, c, g, or t
  misc_feature (1142)..(1142): n is a, c, g, or t
  misc_feature (1144)..(1144): n is a, c, g, or t
  misc_feature (1160)..(1161): n is a, c, g, or t
  misc_feature (1164)..(1164): n is a, c, g, or t
  misc_feature (1166)..(1166): n is a, c, g, or t
  misc_feature (1172)..(1172): n is a, c, g, or t
  misc_feature (1177)..(1177): n is a, c, g, or t
  misc_feature (1183)..(1183): n is a, c, g, or t
  misc_feature (1187)..(1187): n is a, c, g, or t
  misc_feature (1189)..(1189): n is a, c, g, or t
  misc_feature (1191)..(1191): n is a, c, g, or t
  misc_feature (1208)..(1208): n is a, c, g, or t
  misc_feature (1225)..(1225): n is a, c, g, or t
  misc_feature (1228)..(1228): n is a, c, g, or t
  misc_feature (1256)..(1256): n is a, c, g, or t
  misc_feature (1258)..(1258): n is a, c, g, or t
  misc_feature (1263)..(1263): n is a, c, g, or t
  misc_feature (1272)..(1272): n is a, c, g, or t
  misc_feature (1278)..(1278): n is a, c, g, or t
antagagaaattactatgagaggatcgcatcaccatcaccatcacggatcctatttaggtgacactatagaatcgtcgacccacgcgtccgcccacgcgtccggcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgaaaaatcatcccctgaataactttttcctctcgattcccatccccaattttaatattaaattaacaggcaagccggcccccacctctccctggggggtctcaggganaacctttcacggcaccctttccctaccttttccttctttaatctcctggtttaccattgatgacttcncctcttgcatctactgaatttgatttttcattntgccnctcnntctttcaaaccccctcacnttttccatcctaatcctggcntggcattgaaagggtcatgcntttttggggngaacctcttgggtttaagggccccctccnntcctcaantnacctggatttttncccccncttcctnaaaaccccnctnnagggncntacccctatttagggnntgngnaagaanaaaanggttcnaaantncntccccccccccggcccnaaaataaaaaatttccnacnccctttcccccttttttttttatttgcncntttantggggtttnggaaangg

SEQ ID NO: 162 - DNA, 958 bp, Homo sapiens
taactatgagaggatcgcatcaccatcaccatcacggatcctatttaggtgacactatagaatcgtcgacccacgcgtccgcagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctga

SEQ ID NO: 163 - DNA, 1458 bp, Homo sapiens
ccctcccccccctaggcatacttgagaggatcgcatcaccatcaccatcacggtcgacccacgcgtccggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagccatgaatactccacccgggctcccctacagccaggtccgcgacttgctgctaaagaaacttcacctccgcctgaccactcccaccttccacctatccccctcgctcacaccttgcccccgccgccccttccacccccaacctacctatatccccgaccaccatcccccacttcccgcctcgacccaccgcactcaaaaaccaaaatgcactccccaacattacccattaacccccccaccctcataatctgatcacctcacccattccatccaccttcctcttcccacaaccacaccaataccaccaccccccctacacatccaaccctccccaaacacattattccccacatcccccattcacttccacccaaaccacacaactccttaacatcacttacttcccaaatcaacactgctcctcacaaatacaccctgcacccccccctcaccgcccaacacctccctctacaatccctccctcacaccccacctacacccccctccacaccacccacccctcatcatatctcccatcactcatctccccccttcaccaccactcacacccctgccaccacgcaccccctctcaccaccactcacacccacacatccatcacttcacctcccttctcctcaactaaccccctcccacccctcctcaccaacacttaccttcaccaccccacccctaaaccctaccctccccccactcactctctaccacatgctatccccctccccctccaccacctcacactactaccacctcattacctctt

SEQ ID NO: 164 - DNA, 904 bp, Homo sapiens
  misc_feature (797)..(797): n is a, c, g, or t
tatgagaggtcgcatcaccatcaccatcacggatcctatttaggtgacactatagaatcgtcgactctggaccttggctgtcactcagtttaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaatcattaacctccctgttgttgacttcacgaaatgatgtccaaagagcagttcaatgaaggctcacttgccatanttcgggatatcgtaggaggggtaagataaagtggctgctcagaatgcagaaaagaaactggaaatatatagactagagcagatttaatctttgaagatgaaagaaaa

SEQ ID NO: 165 - DNA, 1199 bp, Homo sapiens
  misc_feature (1)..(1): n is a, c, g, or t
  misc_feature (815)..(815): n is a, c, g, or t
  misc_feature (863)..(863): n is a, c, g, or t
  misc_feature (870)..(870): n is a, c, g, or t
  misc_feature (882)..(882): n is a, c, g, or t
  misc_feature (924)..(924): n is a, c, g, or t
  misc_feature (934)..(934): n is a, c, g, or t
  misc_feature (961)..(961): n is a, c, g, or t
  misc_feature (965)..(965): n is a, c, g, or t
  misc_feature (979)..(979): n is a, c, g, or t
  misc_feature (984)..(984): n is a, c, g, or t
  misc_feature (995)..(995): n is a, c, g, or t
  misc_feature (1031)..(1031): n is a, c, g, or t
  misc_feature (1035)..(1035): n is a, c, g, or t
  misc_feature (1042)..(1042): n is a, c, g, or t
  misc_feature (1054)..(1054): n is a, c, g, or t
  misc_feature (1059)..(1059): n is a, c, g, or t
  misc_feature (1061)..(1061): n is a, c, g, or t
  misc_feature (1064)..(1064): n is a, c, g, or t
  misc_feature (1079)..(1079): n is a, c, g, or t
  misc_feature (1104)..(1104): n is a, c, g, or t
  misc_feature (1108)..(1108): n is a, c, g, or t
  misc_feature (1123)..(1125): n is a, c, g, or t
  misc_feature (1129)..(1129): n is a, c, g, or t
  misc_feature (1146)..(1146): n is a, c, g, or t
  misc_feature (1148)..(1148): n is a, c, g, or t
  misc_feature (1152)..(1152): n is a, c, g, or t
  misc_feature (1157)..(1157): n is a, c, g, or t
  misc_feature (1160)..(1161): n is a, c, g, or t
  misc_feature (1166)..(1167): n is a, c, g, or t
  misc_feature (1170)..(1170): n is a, c, g, or t
  misc_feature (1177)..(1177): n is a, c, g, or t
  misc_feature (1180)..(1180): n is a, c, g, or t
  misc_feature (1187)..(1187): n is a, c, g, or t
ntagagaaattactatgagaggatcgcatcaccatcaccatcacggatcctatttaggtgacactatagaatcgtcgacccacgcgtccgcggacgcgtgggcggacgcgtgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaatagcttccaagcttcaccttgaaagaagcttacatggcagcaatatttctaaaaatagtgatacagtcagaggcctcctgtaanggcgagagaactgaagttgatgttgacaggcccacagggaattggccntccctgnttcaagtggaanccagtctctgagaatcccgtgctctcctctcttttggtggangtttctgtangttcaggtttctaccatggacttttangtanataggggcaagtcngccanaaagcaccacncacctcagggaagcccttgtctaaccttttccctancggntctctanccagccagcccnaaaantnctncaaaaacccccttcnctcttttgcagggaaaaaaagcccnccantcccggcttttggannncttntgctgggaaaccaaaancnaatnccttnctnnctggnnccnccccttntgntcccggnaaaatccacccc

SEQ ID NO: 166 - DNA, 1325 bp, Homo sapiens
  misc_feature (1)..(2): n is a, c, g, or t
  misc_feature (872)..(872): n is a, c, g, or t
nncccgcctacccccctaagaatactagagaggacgcatcaccatcaccatcacggtcgacccacgcgtccggccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcatgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgntgagattgaatctgtgtgtgggaccagttcccgggtgagatcaacccacagcacagctggatggtggcaagccctctgctggacatcaaagctgaccccgaagctgtggaaactgtgcccccccttcactttggggctctccaggaactggaactccgctaatcaaaccccgaaaaaaacaactggtccccgaaattctacttggccactgggaaacagggacccggccccaatgcaaaccaaacaaattaactctcggggggcgagcctggtgaaaaccgaaaaaccccagcctgcaaaaaccacgaccccaccaccccgaaaaccaaaccttcccccctgaacccccccatctaccacatatgatacacaaccaaaacatctccctacaccaacaccactgcgaaagcctcctcacaaactatcagtacacgcccgacccacacaaccacc

SEQ ID NO: 167 - DNA, 1133 bp, Homo sapiens
  misc_feature (808)..(808): n is a, c, g, or t
  misc_feature (823)..(823): n is a, c, g, or t
  misc_feature (859)..(859): n is a, c, g, or t
  misc_feature (861)..(861): n is a, c, g, or t
  misc_feature (866)..(866): n is a, c, g, or t
  misc_feature (879)..(879): n is a, c, g, or t
  misc_feature (887)..(887): n is a, c, g, or t
  misc_feature (897)..(897): n is a, c, g, or t
  misc_feature (918)..(918): n is a, c, g, or t
  misc_feature (947)..(947): n is a, c, g, or t
  misc_feature (952)..(952): n is a, c, g, or t
  misc_feature (969)..(969): n is a, c, g, or t
  misc_feature (974)..(974): n is a, c, g, or t
  misc_feature (981)..(981): n is a, c, g, or t
  misc_feature (991)..(991): n is a, c, g, or t
  misc_feature (997)..(997): n is a, c, g, or t
  misc_feature (1014)..(1014): n is a, c, g, or t
  misc_feature (1017)..(1018): n is a, c, g, or t
  misc_feature (1022)..(1022): n is a, c, g, or t
  misc_feature (1034)..(1034): n is a, c, g, or t
  misc_feature (1049)..(1050): n is a, c, g, or t
  misc_feature (1054)..(1054): n is a, c, g, or t
  misc_feature (1057)..(1057): n is a, c, g, or t
  misc_feature (1059)..(1059): n is a, c, g, or t
  misc_feature (1065)..(1065): n is a, c, g, or t
  misc_feature (1074)..(1074): n is a, c, g, or t
  misc_feature (1081)..(1083): n is a, c, g, or t
  misc_feature (1088)..(1089): n is a, c, g, or t
  misc_feature (1096)..(1096): n is a, c, g, or t
  misc_feature (1104)..(1105): n is a, c, g, or t
  misc_feature (1108)..(1108): n is a, c, g, or t
  misc_feature (1112)..(1112): n is a, c, g, or t
  misc_feature (1124)..(1124): n is a, c, g, or t
  misc_feature (1132)..(1132): n is a, c, g, or t
tagagaaattactatgagaggatcgcatcaccatcaccatcacggatcctatttaggtgacactatagaatcgtcgacccacgcgtccgggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccaaaaaccanagccatttgtctcanaccctaaatcaataatcacaaaccccaaaacgggananagcantgaaaacatgcanggctgtgnacgggggaanggttgtggcgggtgttctgangctgaaaagacacctatatgcgtatttcntctanacacatcaccccccttntatantcttaanccatgactancctggnggcgtgtaaatttctgnccnntttnaccccctcatgngcttcttctgaaaanngaangtnantgtttnaaaactggnaaaattnnnccccnnttattgnaaaaaaanntgnaaancttggaaatttntttttttnc

SEQ ID NO: 168 - DNA, 885 bp, Homo sapiens
  misc_feature (4)..(4): n is a, c, g, or t
  misc_feature (17)..(17): n is a, c, g, or t
  misc_feature (25)..(25): n is a, c, g, or t
  misc_feature (59)..(59): n is a, c, g, or t
  misc_feature (253)..(253): n is a, c, g, or t
  misc_feature (256)..(257): n is a, c, g, or t
  misc_feature (744)..(744): n is a, c, g, or t
  misc_feature (860)..(860): n is a, c, g, or t
  misc_feature (868)..(868): n is a, c, g, or t
  misc_feature (874)..(874): n is a, c, g, or t
  misc_feature (876)..(876): n is a, c, g, or t
ttcnttaaagaggaganattaactntgagaggatcgcatcaccatcaccatcacggatnctatttaggtgacactatagaatcgtcgacccacgcgtccggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagaggganttnnagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggngccatgccccctgctcctgtgccagctggtaccccagctcctccaggacctggccactatgatgcccggtggaactttggggattgaccccaccaacaactgaacgctttggtcangctgcttnaatggnangaattgggg

SEQ ID NO: 169 - DNA, 838 bp, Homo sapiens
attactatgagaggtcgcatcaccatcacatcacggatcctatttaggtgacactatagaatcgtcgactctggaccttggctgtcactcagttaaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggccgaaaaggccagacttctaaaaggtccaatagaaaaggagctggatgtagatgctgattttgtagaaacgtcagagttatggagcttgccaccacatgcagaaactgctactgcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaagaaaatatacagtaatcgttaatccag

SEQ ID NO: 170 - DNA, 1401 bp, Homo sapiens
  misc_feature (7)..(7): n is a, c, g, or t
  misc_feature (9)..(10): n is a, c, g, or t
  misc_feature (1005)..(1005): n is a, c, g, or t
acgcccncnncctaagagatactagagaggatcgcatcaccatcaccatcacggtcgacccacgcgtccgcccacgcgtccgggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcaaccccctcacggctacccgaaaccctgtggtcagattacactccaagatgtccgccgcatctacaaaaggaggcacggccctctgcctctgggcttggaagnattttgcaacaaaaatgatttgtggtcccaactttaactaaagtttctagaacctcaaaaaagagaagaaccctatttttacattgccacaacccaaaaaaacctgggggggaacaacctgctgaaaaattattggtgaacggacaggaggaaaccttccaatataaaaactcctttaccctaaaaaccggggcaaacccatgtaaaaacccctcaaaaaccggggttcccgcgaaaaaaatggtgatctcccttgaaaaacaattgcaatacccgaaactcccttgttttccaaaactagtgccccataaaaacaggctgtgaagcactgaacccatcacagtgctgacaactctatgtgggacaactcttccgcgctttacatatcactcctat

SEQ ID NO: 171 - DNA, 948 bp, Homo sapiens
tgagaggatcgcatcaccatcaccatcacggatcctatttaggtgacactatagaatcgtcgacccacgcgtccggcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaactcactgcccaggtggaaga

SEQ ID NO: 172 - DNA, 993 bp, Homo sapiens
  misc_feature (892)..(892): n is a, c, g, or t
  misc_feature (966)..(966): n is a, c, g, or t
  misc_feature (970)..(971): n is a, c, g, or t
  misc_feature (973)..(976): n is a, c, g, or t
  misc_feature (981)..(981): n is a, c, g, or t
  misc_feature (983)..(984): n is a, c, g, or t
  misc_feature (986)..(993): n is a, c, g, or t
attagagaaattactatgagaggatcgcatcaccatcaccatcacggatcctatttaggtgacactatagaatcgtcgacccacgcgtccgcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtaggggccaagcccccaccccatcccantccccttccctccccagatatttatgtgaaatgaactgcagctttatttttttgaaataaaaaacttttaaaangccnnannnnaaaanannannnnnnnn

SEQ ID NO: 173 - DNA, 1048 bp, Homo sapiens
  misc_feature (758)..(758): n is a, c, g, or t
  misc_feature (783)..(783): n is a, c, g, or t
  misc_feature (819)..(819): n is a, c, g, or t
  misc_feature (831)..(831): n is a, c, g, or t
  misc_feature (842)..(842): n is a, c, g, or t
  misc_feature (892)..(892): n is a, c, g, or t
  misc_feature (908)..(908): n is a, c, g, or t
  misc_feature (917)..(917): n is a, c, g, or t
  misc_feature (945)..(945): n is a, c, g, or t
  misc_feature (974)..(974): n is a, c, g, or t
  misc_feature (979)..(979): n is a, c, g, or t
  misc_feature (982)..(982): n is a, c, g, or t
  misc_feature (987)..(987): n is a, c, g, or t
  misc_feature (1003)..(1003): n is a, c, g, or t
  misc_feature (1010)..(1010): n is a, c, g, or t
  misc_feature (1022)..(1022): n is a, c, g, or t
  misc_feature (1027)..(1031): n is a, c, g, or t
  misc_feature (1034)..(1038): n is a, c, g, or t
  misc_feature (1040)..(1040): n is a, c, g, or t
  misc_feature (1043)..(1048): n is a, c, g, or t
agaaattactatgagaggatcgcatcaccatcaccatcacggatcctatttaggtgacactatagaatcgtcgacccacgcgtccggcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccancctgcagccagtgtggaggccaaangatatttgagtttcagcttatgccagcactggtcancatgctcaagantgctaatttangtctttctgtggaatttggaaacaattctagtttacacatgtgaaaaaanttgctggccccccaantcatcaaantccccatggaaaaattttgtattatacnagaaaaacccaaatgaattattgtttaantaaancantttcnttttattaaaataaanttaaaanaaatgttttacntcccnnnnnaannnnnanaannnnnn

SEQ ID NO: 174 - DNA, 1338 bp, Homo sapiens
  misc_feature (991)..(991): n is a, c, g, or t
  misc_feature (1018)..(1018): n is a, c, g, or t
  misc_feature (1024)..(1024): n is a, c, g, or t
  misc_feature (1038)..(1038): n is a, c, g, or t
  misc_feature (1040)..(1040): n is a, c, g, or t
  misc_feature (1056)..(1056): n is a, c, g, or t
  misc_feature (1090)..(1090): n is a, c, g, or t
  misc_feature (1101)..(1101): n is a, c, g, or t
  misc_feature (1125)..(1125): n is a, c, g, or t
  misc_feature (1173)..(1173): n is a, c, g, or t
  misc_feature (1193)..(1193): n is a, c, g, or t
  misc_feature (1197)..(1197): n is a, c, g, or t
  misc_feature (1209)..(1209): n is a, c, g, or t
  misc_feature (1216)..(1216): n is a, c, g, or t
  misc_feature (1221)..(1221): n is a, c, g, or t
  misc_feature (1225)..(1225): n is a, c, g, or t
  misc_feature (1228)..(1228): n is a, c, g, or t
  misc_feature (1242)..(1242): n is a, c, g, or t
  misc_feature (1251)..(1252): n is a, c, g, or t
  misc_feature (1258)..(1258): n is a, c, g, or t
  misc_feature (1260)..(1261): n is a, c, g, or t
  misc_feature (1276)..(1276): n is a, c, g, or t
  misc_feature (1279)..(1279): n is a, c, g, or t
  misc_feature (1281)..(1281): n is a, c, g, or t
  misc_feature (1287)..(1287): n is a, c, g, or t
  misc_feature (1293)..(1293): n is a, c, g, or t
  misc_feature (1303)..(1303): n is a, c, g, or t
  misc_feature (1309)..(1309): n is a, c, g, or t
  misc_feature (1311)..(1311): n is a, c, g, or t
  misc_feature (1328)..(1328): n is a, c, g, or t
  misc_feature (1334)..(1335): n is a, c, g, or t
  misc_feature (1337)..(1338): n is a, c, g, or t
tagagaaattactatgagaggatcgcatcaccatcaccatcacggatcctatttaggtgacactatagaatcgtcgacccacgcgtccggaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggccccaagaagaaggcnaagggggtggtggacgtcaagggccangtgcgnatggaagtgcaagncnagaagaaaaaaaggangacaggaggacaagaggatgagaggatgatgatntgaccctgtgnacaagaagatgcctggggggcaanggagaccccggggcgggatggcaaatcacaacaggggaaaactggggncccaggggcccccaaaaaantaanggaaaagggttncccgttnccccncccnganaagaataaggggcngggggggcnncccgcncnncctgggccggggggnttntnccccangggggnaaatttcccncccggngnggggggggggggaaaantttttnngnn

SEQ ID NO: 175 - DNA, 876 bp, Homo sapiens
  misc_feature (602)..(602): n is a, c, g, or t
  misc_feature (678)..(679): n is a, c, g, or t
  misc_feature (702)..(702): n is a, c, g, or t
  misc_feature (744)..(744): n is a, c, g, or t
  misc_feature (754)..(755): n is a, c, g, or t
  misc_feature (778)..(779): n is a, c, g, or t
  misc_feature (781)..(781): n is a, c, g, or t
  misc_feature (783)..(783): n is a, c, g, or t
  misc_feature (792)..(793): n is a, c, g, or t
  misc_feature (799)..(799): n is a, c, g, or t
  misc_feature (811)..(811): n is a, c, g, or t
  misc_feature (817)..(817): n is a, c, g, or t
  misc_feature (819)..(819): n is a, c, g, or t
  misc_feature (829)..(829): n is a, c, g, or t
  misc_feature (832)..(832): n is a, c, g, or t
  misc_feature (841)..(844): n is a, c, g, or t
  misc_feature (849)..(849): n is a, c, g, or t
  misc_feature (851)..(851): n is a, c, g, or t
  misc_feature (858)..(858): n is a, c, g, or t
  misc_feature (860)..(860): n is a, c, g, or t
  misc_feature (870)..(870): n is a, c, g, or t
  misc_feature (876)..(876): n is a, c, g, or t
aaaatagagaaattactatgagaggatcgcatcaccatcaccatcacggatcctatttaggtgacactatagaatcgtcgacccacgcgtccgcccacgcgtccgcccacgcgtccggtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcanctacatccacctcatgtcccccttcgtggagcacatcctttggcacgtgggcctctcggcctgcctgggcctgacnntggccctgtccctcctctcgganattatcgcccctcctcaccttccacatctactgctttttacntctatggaanncaggctgtaatgcctgaaaaatnnangncccttgtcnntcattntgacgtctgttncggggnanaaaaaattgnaancttttttgnnnnaacgnanggaactncntgtttcctantacctn

SEQ ID NO: 176 - DNA, 1186 bp, Homo sapiens
  misc_feature (1)..(1): n is a, c, g, or t
  misc_feature (880)..(880): n is a, c, g, or t
  misc_feature (947)..(947): n is a, c, g, or t
  misc_feature (959)..(959): n is a, c, g, or t
  misc_feature (975)..(975): n is a, c, g, or t
  misc_feature (987)..(987): n is a, c, g, or t
  misc_feature (992)..(992): n is a, c, g, or t
  misc_feature (1023)..(1023): n is a, c, g, or t
  misc_feature (1028)..(1028): n is a, c, g, or t
  misc_feature (1038)..(1038): n is a, c, g, or t
  misc_feature (1045)..(1045): n is a, c, g, or t
  misc_feature (1063)..(1063): n is a, c, g, or t
  misc_feature (1084)..(1084): n is a, c, g, or t
  misc_feature (1088)..(1088): n is a, c, g, or t
  misc_feature (1091)..(1091): n is a, c, g, or t
  misc_feature (1101)..(1101): n is a, c, g, or t
  misc_feature (1106)..(1106): n is a, c, g, or t
  misc_feature (1108)..(1108): n is a, c, g, or t
  misc_feature (1119)..(1119): n is a, c, g, or t
  misc_feature (1132)..(1132): n is a, c, g, or t
  misc_feature (1137)..(1137): n is a, c, g, or t
  misc_feature (1144)..(1145): n is a, c, g, or t
  misc_feature (1148)..(1148): n is a, c, g, or t
  misc_feature (1150)..(1150): n is a, c, g, or t
  misc_feature (1154)..(1154): n is a, c, g, or t
  misc_feature (1156)..(1156): n is a, c, g, or t
  misc_feature (1166)..(1166): n is a, c, g, or t
  misc_feature (1168)..(1168): n is a, c, g, or t
  misc_feature (1179)..(1179): n is a, c, g, or t
  misc_feature (1181)..(1182): n is a, c, g, or t
naatagagaaattactatgagaggatcgcatcaccatcaccatcacggatcctatttaggtgacactatagaatcgtcgacccacgcgtccgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagataaaaaaaccaccctcaacagccggcaggatagctgantttttcaccgatcttctgacgtggcgtccactggcccaggccacacataatttcctgcgtggcctcnatttccacaaanaatactttcagcatcntcacttttccanatggnaagctacactctggatgggctccccaaccanctganaccctcgganccccacntgtgcctgctggaatgtnggctacctcataaaaacaagntgcntgnccttctggancccantngggaagtgganctctatcctgtantggantaaaacnnccngnaacntncaaaaattgnanctctgggccgntnnccaa

SEQ ID NO: 177 - DNA, 1416 bp, Homo sapiens
gcccccccctgagagatactagagaggatgcatcaccatcaccatcacggtcgacccacgcgtccgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaagggcaggagaaactgcaccagatgtggctcagctggaaccagaagcagctccagggccccgagaaggacccgcccagccagagcaggtcgagtcccgggcgctctcccaggtcccgggaatttgccccccaatgcaggcccctggtcctccctgggtccaacaatccagcccccccaccaggtaaagccccgggccccagcccccccccgtcgaagaccctctaaccatcttccgattccctctctctcacctgcccccacattctgcccatatgcacattttgccccttctctcccccctcattacctgcgcaatgtgtcccactaccctgctcatctcgcgacctctctcccctacctcatacccccctaaacattaccggtctaccacctacaccccccccccatctaaccctcgcatctgccccctatcctcttatccctctctcaccctcgtgccaataccctccgtccctcccttcacacccccaccatacaccattcgccccaccacagcatctcactccctcaccaactctccctaccacgcagcctatccccacacccacaccttac

SEQ ID NO: 178 - DNA, 1349 bp, Homo sapiens
  misc_feature (8)..(8): n is a, c, g, or t
  misc_feature (858)..(858): n is a, c, g, or t
ctccccanggggaacaacctcccaaggaatactcgagaggacgcatcacatcaccatcacggtcgacccacgcgtccggttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctngtctcctaacgttggaaccgaaaggggcgggggtcccggctgacaagccagcatagggcatccgtggccagaaaccgaaggccccccacacgtgctcaccccccgcagcctaagcaagctctgcatgcttagccaggcaggggcaaacctggatttccccccccaggcccaaaatttccaaaaggaaagaaaaacctccgtccaaaagggcccaaaagaagggccccccaaaaaggtttccccccccccccccccccccaaataaaaaccccccctaaaacgggcaacattggaattttgccccaatatccccacctctccgtatagaaccaaaaaaaaatgggcccggcaccccccctccgaggggctccgcaaaaaaaacgcattattaaaggcacccccacaaacaacaaatggcgattgcaaataaacaaccaccccctccctcgcgactcctctcccacatagagctaccaacccccctaccacac

SEQ ID NO: 179 - DNA, 1114 bp, Homo sapiens
  misc_feature (1)..(1): n is a, c, g, or t
  misc_feature (5)..(5): n is a, c, g, or t
  misc_feature (912)..(912): n is a, c, g, or t
  misc_feature (918)..(918): n is a, c, g, or t
  misc_feature (947)..(947): n is a, c, g, or t
  misc_feature (955)..(955): n is a, c, g, or t
  misc_feature (957)..(957): n is a, c, g, or t
  misc_feature (970)..(971): n is a, c, g, or t
  misc_feature (974)..(975): n is a, c, g, or t
  misc_feature (978)..(978): n is a, c, g, or t
  misc_feature (987)..(987): n is a, c, g, or t
  misc_feature (998)..(998): n is a, c, g, or t
  misc_feature (1034)..(1034): n is a, c, g, or t
  misc_feature (1044)..(1044): n is a, c, g, or t
  misc_feature (1058)..(1059): n is a, c, g, or t
  misc_feature (1070)..(1070): n is a, c, g, or t
  misc_feature (1080)..(1080): n is a, c, g, or t
  misc_feature (1095)..(1097): n is a, c, g, or t
  misc_feature (1102)..(1102): n is a, c, g, or t
  misc_feature (1108)..(1108): n is a, c, g, or t
  misc_feature (1110)..(1110): n is a, c, g, or t
naatngagaaaattactatgagaggatcgcatcaccatcaccatcacggatcctatttaggtgacactatagaatcgtcgacccacgcgtccgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaangcctanatgtcttgcggcaaatttgagaaaacagnaagagtcnancaattaccacccnnccnnagntcctggaanctgacgtaaanctcgtgccgacggcaaaacctgccggccgtgggaanccgtggaacntcctctgcagggannaaaagggccanggtctttttntgggggttcccactnnngggcncctacntntggg

SEQ ID NO: 180 - DNA, 934 bp, Homo sapiens
  misc_feature (847)..(847): n is a, c, g, or t
  misc_feature (883)..(883): n is a, c, g, or t
  misc_feature (890)..(890): n is a, c, g, or t
  misc_feature (892)..(892): n is a, c, g, or t
  misc_feature (895)..(896): n is a, c, g, or t
  misc_feature (907)..(913): n is a, c, g, or t
  misc_feature (920)..(920): n is a, c, g, or t
  misc_feature (924)..(924): n is a, c, g, or t
  misc_feature (927)..(927): n is a, c, g, or t
taagagaaattactatgagaggatcgcatcaccatcaccatcacggatcctatttaggtgacactatagaatcgtcgacccacgcgtccgggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataanagatgcccctgtactgatgcaaaatttaataaaagntttgtcncngannaaaaaaaaaannnnnnnaaaaaangggnggnccgctcc

SEQ ID NO: 181 - DNA, 1216 bp, Homo sapiens
  misc_feature (808)..(808): n is a, c, g, or t
  misc_feature (847)..(847): n is a, c, g, or t
  misc_feature (850)..(850): n is a, c, g, or t
  misc_feature (909)..(909): n is a, c, g, or t
  misc_feature (921)..(921): n is a, c, g, or t
  misc_feature (936)..(936): n is a, c, g, or t
  misc_feature (963)..(963): n is a, c, g, or t
  misc_feature (965)..(965): n is a, c, g, or t
  misc_feature (983)..(983): n is a, c, g, or t
  misc_feature (990)..(990): n is a, c, g, or t
  misc_feature (993)..(993): n is a, c, g, or t
  misc_feature (998)..(998): n is a, c, g, or t
  misc_feature (1005)..(1005): n is a, c, g, or t
  misc_feature (1011)..(1011): n is a, c, g, or t
  misc_feature (1015)..(1015): n is a, c, g, or t
  misc_feature (1018)..(1018): n is a, c, g, or t
  misc_feature (1024)..(1025): n is a, c, g, or t
  misc_feature (1029)..(1029): n is a, c, g, or t
  misc_feature (1032)..(1032): n is a, c, g, or t
  misc_feature (1040)..(1040): n is a, c, g, or t
  misc_feature (1051)..(1051): n is a, c, g, or t
  misc_feature (1057)..(1057): n is a, c, g, or t
  misc_feature (1059)..(1059): n is a, c, g, or t
  misc_feature (1076)..(1076): n is a, c, g, or t
  misc_feature (1078)..(1078): n is a, c, g, or t
  misc_feature (1106)..(1106): n is a, c, g, or t
  misc_feature (1119)..(1119): n is a, c, g, or t
  misc_feature (1127)..(1127): n is a, c, g, or t
  misc_feature (1129)..(1130): n is a, c, g, or t
  misc_feature (1135)..(1135): n is a, c, g, or t
  misc_feature (1148)..(1148): n is a, c, g, or t
  misc_feature (1160)..(1160): n is a, c, g, or t
  misc_feature (1164)..(1164): n is a, c, g, or t
  misc_feature (1186)..(1186): n is a, c, g, or t
  misc_feature (1191)..(1192): n is a, c, g, or t
  misc_feature (1202)..(1202): n is a, c, g, or t
  misc_feature (1210)..(1210): n is a, c, g, or t
  misc_feature (1214)..(1214): n is a, c, g, or t
  misc_feature (1216)..(1216): n is a, c, g, or t
atagagaaattactatgagaggatcgcatcaccatcaccatcacggatcctatttaggtgacactatagaatcgtcgacccacgcgtccgccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcancggtggcggtggcagtggtggtggcggtggcggtggcancanccggccaccagccccccaagagaacacaacttctgaggcaggcctgccccagggggaancacggacccganacgacggcgatgagnaaaggctcctgacacacagcgaggaananctggaacacagccagganacaaacncgnatganggggccnttgcantaancancctgannggancantggccacnaccaggtgaanggcatngnttgccccaggcctcaancngggcaccaaccctggatgccccccccancgggtaccaaaanaaactggnannagggncctcctccccaangaatccaaccanggcnatgttctttgcaggggaattangggcnnattcttcccnagaacccncctntn

SEQ ID NO: 182 - DNA, 939 bp, Homo sapiens
tatgagaggtcgcatcaccatcaccatcacggatcctatttaggtgacactatagaatcgtcgacccacgcgtccggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaat

SEQ ID NO: 183 - DNA, 1041 bp, Homo sapiens
  misc_feature (668)..(668): n is a, c, g, or t
  misc_feature (698)..(698): n is a, c, g, or t
  misc_feature (723)..(723): n is a, c, g, or t
  misc_feature (725)..(725): n is a, c, g, or t
  misc_feature (766)..(766): n is a, c, g, or t
  misc_feature (842)..(842): n is a, c, g, or t
  misc_feature (844)..(844): n is a, c, g, or t
  misc_feature (853)..(853): n is a, c, g, or t
  misc_feature (877)..(877): n is a, c, g, or t
  misc_feature (893)..(893): n is a, c, g, or t
  misc_feature (898)..(898): n is a, c, g, or t
  misc_feature (903)..(903): n is a, c, g, or t
  misc_feature (907)..(907): n is a, c, g, or t
  misc_feature (914)..(914): n is a, c, g, or t
  misc_feature (922)..(922): n is a, c, g, or t
  misc_feature (925)..(925): n is a, c, g, or t
  misc_feature (930)..(931): n is a, c, g, or t
  misc_feature (933)..(933): n is a, c, g, or t
  misc_feature (940)..(940): n is a, c, g, or t
  misc_feature (944)..(944): n is a, c, g, or t
  misc_feature (947)..(948): n is a, c, g, or t
  misc_feature (953)..(953): n is a, c, g, or t
  misc_feature (955)..(955): n is a, c, g, or t
  misc_feature (958)..(958): n is a, c, g, or t
  misc_feature (969)..(969): n is a, c, g, or t
  misc_feature (972)..(972): n is a, c, g, or t
  misc_feature (983)..(983): n is a, c, g, or t
  misc_feature (987)..(987): n is a, c, g, or t
  misc_feature (1003)..(1003): n is a, c, g, or t
  misc_feature (1016)..(1016): n is a, c, g, or t
  misc_feature (1028)..(1028): n is a, c, g, or t
  misc_feature (1031)..(1031): n is a, c, g, or t
  misc_feature (1034)..(1034): n is a, c, g, or t
  misc_feature (1040)..(1040): n is a, c, g, or t
tagagagattaactatgagaggatcgcatcaccatcaccatcacggatcctatttaggtgacactatagaatcgtcgacccacgcgtccgacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaaganagcctcccaggatgtactctgtttattaanaatctcaattttgacacaacagaananaagctgaaggaagtgttttcaaaagtggggacagtgaaaanctgctccatctccaagaaaaaaaaacaaagcaggagtgctcctttccatgggggtttggattttgtgggaatacangnaagccggancaagcccaaaaagctctcaagcanctccagggtcacgtcntgganggccncaanctggaantgaggatntcngaacnnanccctaanccanccnngaaantngcntcgaaaaaaanaanttcccaaaaanaaancaccctccaaaaatcntggggggaaaaanccccttccaggnccnaanccgggna

SEQ ID NO: 184 - DNA, 877 bp, Homo sapiens
  misc_feature (790)..(790): n is a, c, g, or t
  misc_feature (807)..(807): n is a, c, g, or t
  misc_feature (839)..(839): n is a, c, g, or t
  misc_feature (853)..(853): n is a, c, g, or t
gagagatactatgagaggacgcatcaccatcaccatcacggatcctatttaggtgacactatagaatcgtcgactctggaccttggctgtcactcagttaaggcctatttccaaaccgaccgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttccagagatctgcagagcagccccacagtgtggggcaggtacnagcagcaacccatatanggattaataattcccccaggttcaaggagtanttcagtttcagaanagcactgacctcgagcatgatgac

SEQ ID NO: 185 - DNA, 1410 bp, Homo sapiens
  misc_feature (1)..(1): n is a, c, g, or t
  misc_feature (713)..(714): n is a, c, g, or t
nggcaaaatacttccaagaattactagagaggatcgcatcaccatcaccatcacggtcgacccacgcgtccgactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtannagtatacctacagaatgtgccatcaaggtattttaaacaacccttaatgaattaagaatcgtgacaaatatattaaagatgatttcaggtttaaagatcgcttccgaaaactaatccacgttaaatcatcccgcatggggggcaaaaaaaaaatgcccattccccaaaaatgcgaaaaactgggaatccttggcccaccgttggaccaatgaaaaaaccactttaagttaaggcctttatgggcccggaccaatcccccacccccaaattaaaaaaagtaagcctccaaagtgcaaaaatgaaaaaacccccttaacctcctttttttatccccgattatctctaaagggccacctccccagctccacaccaaaaaaacacaccacgcctaaccaaaaacaccagacacacactaaccaccaacaaacaccacccacccacacccacattacactaaccacccaccacccatcctactctttaactaaacaccaccacacccatccctcgcctcacccgtccacaacaccccccctcacacagacacatcctaccacaacaccaccaataatacaccgtctaccctaccaccctcacacacttcctccccactcacaacactactccaatcaacaaccaccacaccaaacacaacaagctcccacctccaaccaaaccaccgctcacacaacctca

SEQ ID NO: 186 - DNA, 1408 bp, Homo sapiens
  misc_feature (4)..(4): n is a, c, g, or t
  misc_feature (605)..(606): n is a, c, g, or t
  misc_feature (608)..(609): n is a, c, g, or t
  misc_feature (611)..(613): n is a, c, g, or t
  misc_feature (615)..(618): n is a, c, g, or t
  misc_feature (623)..(623): n is a, c, g, or t
  misc_feature (626)..(626): n is a, c, g, or t
  misc_feature (628)..(628): n is a, c, g, or t
  misc_feature (644)..(644): n is a, c, g, or t
  misc_feature (681)..(681): n is a, c, g, or t
  misc_feature (782)..(782): n is a, c, g, or t
cgcncttaagagatactagagaggatgcatcccatcaccatcacggtcgacccacgcgtccggctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgccctggtgggnncnncnnngnnnnttccnctncnctgccccccctccccntgccagcatggttcccgcccctgtccctgccgctcgnttgcccgcttccgcacacgccccaaaaccggcacattgctatcctgattataaccaacccctacatccacaacactcttcctcccgctccccccatccttnaaaaaaagttatattatacctcttattttaatttaatatccacgccaactcttatacccacaaaacaccccactacccattcccccaccatcaaccccaaacaccacttcccctaacactatcccctacactccacatgacctccccctcaaatacacccactctttccaaactcacatcacactccatactcaaacccactcactaattcttcccccccaccattctcacccaaatctcaacaccctcacatcacccttccttactcaccccctctaccatccatcccacccctatcacccctctcacaccaacacccccaccctctacaccccccactccctctccctctctccaccacccccttcacactccacacaccacccacactcgctctcctctcacctcactcctccccccattccgccgcctcccctcctctcccacaccctcccctcttctttcttcactccactttccccccacttacacactatcaaaatacactcacctacatcatcccacaccccaccacttccactctctcccccacacccacacctacaatcacctctccatacctcatcccatctcccactaatctcgctccctttaccttcccctca

SEQ ID NO: 187 - DNA, 1083 bp, Homo sapiens
  misc_feature (1)..(1): n is a, c, g, or t
  misc_feature (4)..(4): n is a, c, g, or t
  misc_feature (855)..(855): n is a, c, g, or t
  misc_feature (860)..(860): n is a, c, g, or t
  misc_feature (878)..(878): n is a, c, g, or t
  misc_feature (913)..(913): n is a, c, g, or t
  misc_feature (928)..(928): n is a, c, g, or t
  misc_feature (930)..(930): n is a, c, g, or t
  misc_feature (940)..(940): n is a, c, g, or t
  misc_feature (951)..(951): n is a, c, g, or t
  misc_feature (956)..(957): n is a, c, g, or t
  misc_feature (960)..(960): n is a, c, g, or t
  misc_feature (962)..(962): n is a, c, g, or t
  misc_feature (980)..(980): n is a, c, g, or t
  misc_feature (984)..(984): n is a, c, g, or t
  misc_feature (990)..(990): n is a, c, g, or t
  misc_feature (996)..(996): n is a, c, g, or t
  misc_feature (999)..(999): n is a, c, g, or t
  misc_feature (1005)..(1005): n is a, c, g, or t
  misc_feature (1009)..(1009): n is a, c, g, or t
  misc_feature (1018)..(1018): n is a, c, g, or t
  misc_feature (1021)..(1021): n is a, c, g, or t
  misc_feature (1026)..(1026): n is a, c, g, or t
  misc_feature (1043)..(1043): n is a, c, g, or t
  misc_feature (1053)..(1053): n is a, c, g, or t
  misc_feature (1059)..(1059): n is a, c, g, or t
  misc_feature (1067)..(1067): n is a, c, g, or t
  misc_feature (1070)..(1070): n is a, c, g, or t
  misc_feature (1072)..(1072): n is a, c, g, or t
  misc_feature (1075)..(1075): n is a, c, g, or t
  misc_feature (1080)..(1080): n is a, c, g, or t
  misc_feature (1083)..(1083): n is a, c, g, or t
ntanttagagaaattactatgagaggatcgcatcaccatcaccatcacggatcctatttaggtgacactatagaatcgtcgacccacgcgtccgtgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgcccttgtctggaaagaagtttgactacagggcctttgcggccctgccttcttccagacctgtctatgacatccagtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctanaggancaggcacctcccccaganttggggtgggggccctgccagctccagcaccaccnttgcccaagtctttnanctgggtgtancattttaaaanacccnnagnanttttggcctgtgactaantaantgcccnacccanccnaaactnggcnaaatgtaantantgatnttttacaaccaaaaatnttttttttgnttaagnaaaaaaanttnantanttttnctn

SEQ ID NO: 188 - DNA, 759 bp, Homo sapiens
  misc_feature (3)..(3): n is a, c, g, or t
  misc_feature (7)..(7): n is a, c, g, or t
  misc_feature (17)..(17): n is a, c, g, or t
  misc_feature (22)..(22): n is a, c, g, or t
  misc_feature (25)..(25): n is a, c, g, or t
  misc_feature (67)..(67): n is a, c, g, or t
  misc_feature (81)..(81): n is a, c, g, or t
  misc_feature (91)..(91): n is a, c, g, or t
  misc_feature (116)..(116): n is a, c, g, or t
  misc_feature (184)..(184): n is a, c, g, or t
  misc_feature (229)..(229): n is a, c, g, or t
  misc_feature (245)..(245): n is a, c, g, or t
  misc_feature (282)..(282): n is a, c, g, or t
  misc_feature (294)..(294): n is a, c, g, or t
  misc_feature (337)..(337): n is a, c, g, or t
  misc_feature (343)..(343): n is a, c, g, or t
  misc_feature (364)..(364): n is a, c, g, or t
  misc_feature (371)..(371): n is a, c, g, or t
  misc_feature (391)..(391): n is a, c, g, or t
  misc_feature (396)..(396): n is a, c, g, or t
  misc_feature (415)..(416): n is a, c, g, or t
  misc_feature (419)..(419): n is a, c, g, or t
  misc_feature (423)..(424): n is a, c, g, or t
  misc_feature (427)..(427): n is a, c, g, or t
  misc_feature (429)..(429): n is a, c, g, or t
  misc_feature (450)..(450): n is a, c, g, or t
  misc_feature (455)..(455): n is a, c, g, or t
  misc_feature (485)..(485): n is a, c, g, or t
  misc_feature (506)..(508): n is a, c, g, or t
  misc_feature (514)..(514): n is a, c, g, or t
  misc_feature (516)..(516): n is a, c, g, or t
  misc_feature (532)..(532): n is a, c, g, or t
  misc_feature (543)..(543): n is a, c, g, or t
  misc_feature (550)..(550): n is a, c, g, or t
  misc_feature (563)..(563): n is a, c, g, or t
  misc_feature (584)..(584): n is a, c, g, or t
  misc_feature (586)..(586): n is a, c, g, or t
  misc_feature (589)..(589): n is a, c, g, or t
  misc_feature (593)..(593): n is a, c, g, or t
  misc_feature (604)..(604): n is a, c, g, or t
  misc_feature (614)..(614): n is a, c, g, or t
  misc_feature (621)..(622): n is a, c, g, or t
  misc_feature (633)..(634): n is a, c, g, or t
  misc_feature (640)..(640): n is a, c, g, or t
  misc_feature (658)..(659): n is a, c, g, or t
  misc_feature (661)..(661): n is a, c, g, or t
  misc_feature (668)..(668): n is a, c, g, or t
  misc_feature (678)..(678): n is a, c, g, or t
  misc_feature (682)..(682): n is a, c, g, or t
  misc_feature (695)..(695): n is a, c, g, or t
  misc_feature (699)..(699): n is a, c, g, or t
  misc_feature (701)..(701): n is a, c, g, or t
  misc_feature (707)..(707): n is a, c, g, or t
  misc_feature (726)..(726): n is a, c, g, or t
  misc_feature (731)..(731): n is a, c, g, or t
  misc_feature (745)..(745): n is a, c, g, or t
  misc_feature (750)..(750): n is a, c, g, or t
aanaaantagagaaaanttacntangagaggatcgcatcaccatcaccatcacggtatcctatttangatgacacttattnttaatcgtcnacccacgtcgtccgggcggcgtccncggtttcgcaggtctttcgctgagcgtctctgcttagccgcggtcatgagccggcacagtccggctgnagaggcaggttctgagcctgtaccgcgatctgctgcgcgccgggngtgggaagccgggcgncgaggcgcgagtgcgggcagagttccggcagcatgcnggcctgccgcgntccgacgtgctgcgcatcgagtacctgtaccgccgcgggcggngccagntgcagctgctacgctcgggcnacgccancgccatgggcgccttcgtangcccncgggccccgaccggggagnntgncggnntgngntcccagcctgacgacggctanagtcnaaggaacccccacaacagttacgggggcancggagacccggcccgactgannnagacangnaaatagccaaaactcnctcgatggcanggtgganccaggaagctcgnctgactgcatggggggactgngnaanccancctaaggtganagatcttaanaaactannttgacgaattnnggatgncatagactcctccttggnnangcaaggngcctacagancccnttgatggactgcnaggnangccccncctttttcgatgcttgganactgntctgtgctcctccnccatnatggcttag

SEQ ID NO: 189 - DNA, 880 bp, Homo sapiens
cattgagagatactatgagaggatgcatcaccatcaccatcacggatcctatttaggtgacactatagaatcgtcgactctggaccttggctgtcactcagtttatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctccttcctccttcatgccctgcggggcggctgcaccagccggggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcatcaactactgcactaccagaccaccaagcagaacctctggtcctgtcggcggcaagcgagcagcctgcgcaggtggctggagctgaacagagaggagccagggcctgaggaccaggaagtagagcaccacgtgcagaaagagcaggaacaggtggaaatgcatatccacctgctggcaaaggagctccaggctcagcgccagcccattggcgcctgcgttagccgcaatctggccctgcagcaggctctgtgctagcgtgttcgcaccagaaaagcaagtgctgggctgtcagggaagctcaagctactcccggaacaaaccaagatttagtttgatttttatattcaaaatctttgcaattagtgagtactgttcaaaaaaaattaaaaa

SEQ ID NO: 190 - DNA, 468 bp, Homo sapiens
  misc_feature (4)..(4): n is a, c, g, or t
  misc_feature (6)..(6): n is a, c, g, or t
  misc_feature (8)..(9): n is a, c, g, or t
  misc_feature (11)..(11): n is a, c, g, or t
  misc_feature (20)..(20): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (36)..(36): n is a, c, g, or t
  misc_feature (42)..(42): n is a, c, g, or t
  misc_feature (54)..(54): n is a, c, g, or t
  misc_feature (83)..(83): n is a, c, g, or t
  misc_feature (280)..(280): n is a, c, g, or t
  misc_feature (286)..(286): n is a, c, g, or t
  misc_feature (325)..(326): n is a, c, g, or t
  misc_feature (342)..(342): n is a, c, g, or t
  misc_feature (398)..(398): n is a, c, g, or t
  misc_feature (404)..(405): n is a, c, g, or t
  misc_feature (412)..(412): n is a, c, g, or t
  misc_feature (433)..(433): n is a, c, g, or t
  misc_feature (440)..(440): n is a, c, g, or t
  misc_feature (443)..(443): n is a, c, g, or t
  misc_feature (451)..(451): n is a, c, g, or t
  misc_feature (467)..(467): n is a, c, g, or t
aaanangnntnaaaaaaacnaatnctntngngcagnagtatnttaactatgagnaggatcgcatcaccatacaccatcacggnatcctatttaggtgacactatagaatcgtcgacccacgcgtccgctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagntttttntagagctttggctgaaattgccaaagccgaactgggtgnnacacccatgagaggcnccacagcttcgagttcgctttgccacacatgctgctgccctttctgttcgtaaaanaaaaanntatgttnccaatgaactgttggaagaancctttanccnatttggtnctattgaaagggctgnt

SEQ ID NO: 191 - DNA, 895 bp, Homo sapiens
  misc_feature (792)..(792): n is a, c, g, or t
  misc_feature (836)..(837): n is a, c, g, or t
  misc_feature (839)..(840): n is a, c, g, or t
  misc_feature (844)..(846): n is a, c, g, or t
  misc_feature (848)..(851): n is a, c, g, or t
  misc_feature (853)..(856): n is a, c, g, or t
  misc_feature (858)..(862): n is a, c, g, or t
  misc_feature (866)..(866): n is a, c, g, or t
tagagagaattactatgagaggatcgcatcaccatcaccatcacggatcctatttaggtgacactatagaatcgtcgacccacgcgtccggtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccntaaaaggcaattaaatgatgtcctgttccattggaaaaaaaaannannaaannnannnnannnnannnnngggncggccgctcccttataaggagtccgtatt

SEQ ID NO: 192 - DNA, 1023 bp, Homo sapiens
  misc_feature (1)..(1): n is a, c, g, or t
  misc_feature (836)..(836): n is a, c, g, or t
  misc_feature (838)..(838): n is a, c, g, or t
  misc_feature (843)..(843): n is a, c, g, or t
  misc_feature (864)..(864): n is a, c, g, or t
  misc_feature (871)..(871): n is a, c, g, or t
  misc_feature (874)..(874): n is a, c, g, or t
  misc_feature (878)..(878): n is a, c, g, or t
  misc_feature (880)..(880): n is a, c, g, or t
  misc_feature (921)..(921): n is a, c, g, or t
  misc_feature (930)..(930): n is a, c, g, or t
  misc_feature (943)..(943): n is a, c, g, or t
  misc_feature (966)..(966): n is a, c, g, or t
  misc_feature (973)..(974): n is a, c, g, or t
  misc_feature (977)..(977): n is a, c, g, or t
  misc_feature (981)..(981): n is a, c, g, or t
  misc_feature (997)..(997): n is a, c, g, or t
  misc_feature (1002)..(1002): n is a, c, g, or t
  misc_feature (1008)..(1008): n is a, c, g, or t
  misc_feature (1012)..(1013): n is a, c, g, or t
  misc_feature (1016)..(1018): n is a, c, g, or t
  misc_feature (1021)..(1021): n is a, c, g, or t
nttagagaaattactatgagaggatcgcatcaccatcaccatcacggatcctatttaggtgacactatagaatcgtcgacccacgcgtccgcccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcanancccancacaggagctttctctggcanaattgangangaanangtggccctctgacttgacaagccttctgttctgcccaggcnttccaccangaatctccgaggntcccagggcccgcttctccgtanaccccanntcntagntctcaaaaactccccncctgnggtttnctgnnccnnnaantt

SEQ ID NO: 193 - DNA, 828 bp, Homo sapiens
  misc_feature (2)..(2): n is a, c, g, or t
  misc_feature (749)..(749): n is a, c, g, or t
  misc_feature (751)..(751): n is a, c, g, or t
  misc_feature (762)..(762): n is a, c, g, or t
  misc_feature (785)..(785): n is a, c, g, or t
  misc_feature (796)..(796): n is a, c, g, or t
  misc_feature (804)..(804): n is a, c, g, or t
  misc_feature (812)..(812): n is a, c, g, or t
  misc_feature (821)..(822): n is a, c, g, or t
tnaactatgagaggatcgcatcaccatcaccatcacggatcctatttaggtgacactatagaatcgtcgacccacgcgtccgacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacgggtcaccaaccctgggagccccctcggggcagatcagaggctcccgattccctcaatggcccactgggccccagtgaggctagcattgccagcaatctacaagccatgtccacccaagatgttccagactaagcgctgcttcccgactggcccccacctttnanaacctgtttcntccagcccaaccaccaaaccctnataccttcggncagcccanaggccttngcgttcaannggggaa

SEQ ID NO: 194 - DNA, 1338 bp, Homo sapiens
ccatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggccgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggatcccaccccccgacccggccgccccccaccgcgttcatcccccaccccaaaccctccatctacatgccgagcccacgacccccaccacatctccaacccatacaacgctcccaacaacacctcacaccacccctacacccctcaacattcccccccctatcaccccactcttccatatacttccccacaaccgaccatcactacacacaacaaacatacacctccaccctcatctacacaaccgccacccacatccgttactcctcaccattccccacaccatgcacctcactacatacagcaaccatcttccaagcaatcctactcctacaccacacttccgcgatccacacgaatacaccccgcaaaccccctgcaatccaaccacacccgatccacccacacacacatccacatctctacccctctatacaacactcacaccacaaacaccacacaacttaacacactcctcctcaacaccccacgcattaccaccaccactacacactctatcacacaacatatcgcccaacacactaaacacacacaactcaccccccccattttttggttgccctgctcccatccatacctaaccaacacacatatccaacacacaccaccatacctaaaccttccgtacaaacaccctccaaccactccatatacccctcaaaaccctaacacatcacccacattaaacaatatcctactatcaccacaactgacacacactacacataccaccacctattcataatgcaaaaggcacacaaccaccacaccgccatacagacgacctctccattactcgcacagcag

SEQ ID NO: 195 - DNA, 497 bp, Homo sapiens
  misc_feature (373)..(373): n is a, c, g, or t
  misc_feature (379)..(380): n is a, c, g, or t
  misc_feature (382)..(382): n is a, c, g, or t
  misc_feature (385)..(385): n is a, c, g, or t
  misc_feature (391)..(391): n is a, c, g, or t
  misc_feature (404)..(404): n is a, c, g, or t
  misc_feature (406)..(407): n is a, c, g, or t
  misc_feature (414)..(414): n is a, c, g, or t
  misc_feature (416)..(416): n is a, c, g, or t
  misc_feature (438)..(438): n is a, c, g, or t
  misc_feature (440)..(440): n is a, c, g, or t
  misc_feature (455)..(455): n is a, c, g, or t
  misc_feature (460)..(460): n is a, c, g, or t
  misc_feature (463)..(463): n is a, c, g, or t
  misc_feature (466)..(466): n is a, c, g, or t
  misc_feature (469)..(469): n is a, c, g, or t
  misc_feature (477)..(477): n is a, c, g, or t
  misc_feature (487)..(487): n is a, c, g, or t
  misc_feature (489)..(489): n is a, c, g, or t
taagaggagaattaactatgagaggatcgcatcaccatcaccatcacggatcctatttaggtgacactatagaatcgtcgacccacgcgtccgagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaaagggnaccgcnncnttntcaaanaatgacctggccnanntccgaangngggggccttttggcctgaaatngncccccaccccccggnggganggnccnccncgcccccnaattggaaangncatttggg

SEQ ID NO: 196 - DNA, 1388 bp, Homo sapiens
  misc_feature (8)..(12): n is a, c, g, or t
gcagaaannnnnggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccggaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggaaacccctgcatttcctctacgcccaggtccctgaaggggtgaaaagcccccatatgcatgacagtgcataggaaggccacgccttgacactcacacaagcccctcctacccctaatatgaaaaccaaccatcccaaccacgaaacatatcaccatcaccctcgcccacaaacacaccctacataccccccccctctcattccacataaccacctaacacataactgataaatccatgacccaaacccccacccaccaatactatccaaaccttctatacaacgcaaacctcacaaaatatccaactctaccccacgctctataacacactacaccccatccccctctcactcaacataacatcacacacatcaacaaatactcactttttcagtcccactctaccactacccactcccccatctcactcaccacactatcaaccaacaacaccaacaagcccattcaaacccactccaccctcagaacacatagattccctcacccccatacatctaaaatcaaatcactccaatccctccacccctatttctcaacatactacctcttcccccctccacataaaccattaccctcacataccacatctctaacacaacttctggagtaacaagatcatttgaccatcaaccacgcacactaacactactcaccccacattacaaaattcaatctaaactccaccaatatatcttttaatcttcaacaatcttgtctaat

SEQ ID NO: 197 - DNA, 879 bp, Homo sapiens
  misc_feature (11)..(12): n is a, c, g, or t
  misc_feature (14)..(15): n is a, c, g, or t
  misc_feature (38)..(38): n is a, c, g, or t
  misc_feature (50)..(50): n is a, c, g, or t
  misc_feature (56)..(56): n is a, c, g, or t
  misc_feature (59)..(59): n is a, c, g, or t
  misc_feature (69)..(69): n is a, c, g, or t
  misc_feature (101)..(101): n is a, c, g, or t
  misc_feature (166)..(167): n is a, c, g, or t
  misc_feature (169)..(169): n is a, c, g, or t
  misc_feature (183)..(183): n is a, c, g, or t
  misc_feature (286)..(287): n is a, c, g, or t
  misc_feature (291)..(291): n is a, c, g, or t
  misc_feature (328)..(330): n is a, c, g, or t
  misc_feature (636)..(636): n is a, c, g, or t
  misc_feature (662)..(662): n is a, c, g, or t
  misc_feature (702)..(702): n is a, c, g, or t
  misc_feature (732)..(732): n is a, c, g, or t
  misc_feature (739)..(739): n is a, c, g, or t
  misc_feature (742)..(742): n is a, c, g, or t
  misc_feature (769)..(769): n is a, c, g, or t
  misc_feature (774)..(774): n is a, c, g, or t
  misc_feature (784)..(784): n is a, c, g, or t
  misc_feature (788)..(788): n is a, c, g, or t
  misc_feature (791)..(791): n is a, c, g, or t
  misc_feature (797)..(797): n is a, c, g, or t
  misc_feature (802)..(802): n is a, c, g, or t
  misc_feature (806)..(806): n is a, c, g, or t
  misc_feature (815)..(815): n is a, c, g, or t
  misc_feature (821)..(821): n is a, c, g, or t
  misc_feature (825)..(825): n is a, c, g, or t
  misc_feature (834)..(834): n is a, c, g, or t
  misc_feature (842)..(842): n is a, c, g, or t
  misc_feature (850)..(850): n is a, c, g, or t
  misc_feature (853)..(853): n is a, c, g, or t
  misc_feature (856)..(856): n is a, c, g, or t
  misc_feature (860)..(861): n is a, c, g, or t
  misc_feature (865)..(865): n is a, c, g, or t
  misc_feature (868)..(868): n is a, c, g, or t
  misc_feature (871)..(872): n is a, c, g, or t
  misc_feature (876)..(876): n is a, c, g, or t
  misc_feature (879)..(879): n is a, c, g, or t
tgcaaaaattnntnntaaaaccccaattctttaagccngaaataatttanctatgnagnggtttcgcancaccatacaccatcacggtatcctatttaggngacactataaaatcgtcgacccacgcgtccgttttagaaggtgttcactttttacacactcgggnngnagttcatcctgatnagaagcctcagaatattctgttgacaagtgaatctccattgggtgacattaagattgttgattttggcctttcaagaatattgaagaacagtgaagagctccnntttnttatgggtacccctgaatatgtggctcctgaaattgnnngttatgatcctataaccctggcaacagatatgtggagcattggagtgttaacatatgtcatgcttacaggaatataacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactanaagaagcaaatgccctccaagaaggncattctgtgcctgaaattaattcggataccgacaaatcanaaaccgaggaatccattggaaccgaagagntaattgnagntacttcatatactctaggacaatgcanacagnctgaaaaganaaanggngcaaanggccntttnccaaacganttaaanttgnggaaccttngctacaanaaattccnggnaanttanntacnggncanntttnccn

SEQ ID NO: 198 - DNA, 1179 bp, Homo sapiens
  misc_feature (929)..(929): n is a, c, g, or t
  misc_feature (932)..(932): n is a, c, g, or t
  misc_feature (952)..(952): n is a, c, g, or t
  misc_feature (983)..(983): n is a, c, g, or t
  misc_feature (987)..(987): n is a, c, g, or t
  misc_feature (999)..(999): n is a, c, g, or t
  misc_feature (1015)..(1015): n is a, c, g, or t
  misc_feature (1024)..(1024): n is a, c, g, or t
  misc_feature (1038)..(1038): n is a, c, g, or t
  misc_feature (1046)..(1046): n is a, c, g, or t
  misc_feature (1059)..(1059): n is a, c, g, or t
  misc_feature (1065)..(1065): n is a, c, g, or t
  misc_feature (1069)..(1069): n is a, c, g, or t
  misc_feature (1109)..(1109): n is a, c, g, or t
  misc_feature (1112)..(1112): n is a, c, g, or t
  misc_feature (1121)..(1121): n is a, c, g, or t
  misc_feature (1128)..(1128): n is a, c, g, or t
  misc_feature (1130)..(1130): n is a, c, g, or t
  misc_feature (1152)..(1152): n is a, c, g, or t
  misc_feature (1154)..(1154): n is a, c, g, or t
  misc_feature (1159)..(1159): n is a, c, g, or t
  misc_feature (1161)..(1162): n is a, c, g, or t
tagagaaattactatgagaggatcgcatcaccatcaccatcacggatcctatttaggtgacactatagaatcgtcgacccacgcgtccggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccntcntacgtgcaattctgagttanaggtaaagccctgttgtaaaataaaggctcnagcnaaattgtacagngatagcactttccccncaggacgtngaaaacagtaatgnggctaccngttttttaactgnaaaacntccnctggctctttatttttgactaaccatattttaaccaatcntantaccccctnttagggntnctagttgctaaatcccccccangnacttngnntttgattttttgcaaag

SEQ ID NO: 199 - DNA, 879 bp, Homo sapiens
  misc_feature (745)..(745): n is a, c, g, or t
  misc_feature (747)..(747): n is a, c, g, or t
  misc_feature (753)..(772): n is a, c, g, or t
aaaactatgagaggtcgcatcaccatcaccatcacggatcctatttaggtgacactatagaatcgtcgactctggaccttggctgtcactcagttgaaatagccgcagcctctgcgcgtcgccctccacggttaccgcggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggctggtcttcaactcctggcctccagtgatcctcccaccccagcctctcagagtcctgggatgataagcgcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaananaaaaannnnnnnnnnnnnnnnnnnncgagcggccgctcctatagtgagtcgtattagcttaatagctgagctggactcctgtgataatcagtatgactcaaactcatctggattgtcaaacgctcgtgcgcc

SEQ ID NO: 200 - DNA, 743 bp, Homo sapiens
ctatgagaggatcgcatcaccatcaccatcacggatcctatttaggtgacactatagaatcgtcgactctggacttggctgtcactcagttaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcatgcccagtggctgctccttccttcacctctgaaaacggccctcttgaagggggatgtgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcat

SEQ ID NO: 201 - DNA, 1318 bp, Homo sapiens
accacaccccgccccacccccccccaagaaattactagagaggatcgcatcaccatcaccatcacggtcgacccacgcgtccgcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcggcctgcctccgatcccctgctctcctcagtgtcccctgctgtctcccacgtcaacaatccccgcaacaaccttagcatggaagaccagccctgcccaaatcccccccatcacatgaaaccctccccccctacaaacaagtacccacccagacccatcccccactatatcaccaccctccaaacaccaccaccacccactccccatatcccaccaccaaccacccccaacacccccctaccaccaccactcaccctacaacactcaatccaacactccatccaccttaccctcacaccatattctatcccacatactaccaccaaccacccccatccaaacattacactacccaacacctccactacccatcctcccacaacaaccaacccaccacaacaatccacacataactcaataaccacaaccccaccccctatcaacccaactttccataaaaacacattcctaccacccacaccctaccgcacacaatcaccactcaccccacaccctacctttaccaccacacaccaccccaacacactcatccaaccatcaacacacccacaccactaacacctctccataacttatcacacaactctcaccaccatcacaatccctcatacaaacatccccactcacaccatccatcacctcaactccac

SEQ ID NO: 202 - DNA, 617 bp, Homo sapiens
  misc_feature (9)..(9): n is a, c, g, or t
  misc_feature (42)..(42): n is a, c, g, or t
  misc_feature (46)..(47): n is a, c, g, or t
  misc_feature (52)..(52): n is a, c, g, or t
tcgagaatntaaaaattatttgctttgtgagcggatacaatntaanngattnattgtgagcggataacaatttacacagaattcattaaagaggagaaattaactatgagaggatcgcatcaccatcaccatcacggatcctatttaggtgacactatagaatcgtcgacccacgcgtccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagct

SEQ ID NO: 203 - DNA, 852 bp, Homo sapiens
  misc_feature (712)..(712): n is a, c, g, or t
  misc_feature (761)..(761): n is a, c, g, or t
  misc_feature (804)..(804): n is a, c, g, or t
  misc_feature (820)..(820): n is a, c, g, or t
  misc_feature (842)..(843): n is a, c, g, or t
ggaattactatgagaggtcgcatcccatcaccatcacggatcctatttaggtgacactatagaatcgtcgactctggaccttggctgtcactcagttaatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctgaaagaacgggccaaagccgcggaccgattgcccaacctctccagcccctcagctgaggggcccccgggtcccccatctggcccagcgccccggaagaagacccaggagaaagatgatgacgtgctgtttgcctatgagtgtggggtctggcaccctgcagcccangtcccactgctctcacaccttaggctgggacctcctccctctcctgtgntaggctgctttggggggtgcttggtaccccctttctcctcttngagacggactgcccanctgtggctggggtgtggagcannggataactg

SEQ ID NO: 204 - DNA, 1041 bp, Homo sapiens
  misc_feature (1)..(1): n is a, c, g, or t
  misc_feature (3)..(3): n is a, c, g, or t
  misc_feature (997)..(997): n is a, c, g, or t
  misc_feature (1003)..(1003): n is a, c, g, or t
  misc_feature (1006)..(1006): n is a, c, g, or t
  misc_feature (1011)..(1011): n is a, c, g, or t
  misc_feature (1013)..(1013): n is a, c, g, or t
  misc_feature (1030)..(1030): n is a, c, g, or t
  misc_feature (1039)..(1039): n is a, c, g, or t
nantagagaaattactatgagaggatcgcatcaccatcaccatcacggatcctatttaggtgacactatagaatcgtcgacccacgcgtccgcgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttaacatcctgccttaaagccaggcacacactgtgctttctatngtacanaanctctncntttcagtgtcaataacnctgtgtaanct

SEQ ID NO: 205 - DNA, 1026 bp, Homo sapiens
  misc_feature (12)..(12): n is a, c, g, or t
  misc_feature (824)..(824): n is a, c, g, or t
  misc_feature (837)..(837): n is a, c, g, or t
  misc_feature (857)..(857): n is a, c, g, or t
  misc_feature (874)..(874): n is a, c, g, or t
  misc_feature (890)..(890): n is a, c, g, or t
  misc_feature (894)..(894): n is a, c, g, or t
  misc_feature (898)..(898): n is a, c, g, or t
  misc_feature (965)..(965): n is a, c, g, or t
  misc_feature (979)..(979): n is a, c, g, or t
  misc_feature (982)..(982): n is a, c, g, or t
  misc_feature (997)..(997): n is a, c, g, or t
  misc_feature (1001)..(1001): n is a, c, g, or t
  misc_feature (1009)..(1009): n is a, c, g, or t
  misc_feature (1016)..(1016): n is a, c, g, or t
tagagaaattanctatgagaggatcgcatcaccatcaccatcacggatcctatttaggtgacactatagaatcgtcgacccacgcgtccgcccggtgcgcgggtatggcggccagcctgtggatgggcgacgtgagtgagggcagccgtccggggtctgaagacaaggaagcatctcggtttcgcgagagactggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggcagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctgganacagtgtcttcanagatccctgccatgatgtanccaggccaaaggacaancccaggttgcatgatntgangganatgaaaaactcctttttaaaaattgtgaaaaccttttttggaaaaaatgatttggaaaaattttaanaatgactgtttttnganaatcatgaatgtttnttanaaaaactngctggcntttctttttg

SEQ ID NO: 206 - DNA, 1393 bp, Homo sapiens
  misc_feature (4)..(8): n is a, c, g, or t
  misc_feature (1152)..(1152): n is a, c, g, or t
  misc_feature (1182)..(1182): n is a, c, g, or t
  misc_feature (1203)..(1203): n is a, c, g, or t
  misc_feature (1223)..(1223): n is a, c, g, or t
  misc_feature (1241)..(1242): n is a, c, g, or t
  misc_feature (1272)..(1272): n is a, c, g, or t
  misc_feature (1287)..(1287): n is a, c, g, or t
  misc_feature (1344)..(1344): n is a, c, g, or t
  misc_feature (1369)..(1369): n is a, c, g, or t
  misc_feature (1375)..(1375): n is a, c, g, or t
  misc_feature (1386)..(1386): n is a, c, g, or t
aacnnnnnctaagagatactagagaggatgcatcaccatcaccatcacggtcgacccacgcgtccggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgtggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcaatgtcggaaggccagctttgacctctatggcgctgacttcgtgttcggggaggacttccagccctggctgattgagatcacgccagcccccgatggcaccctccacacagtcactgcccggctctgtgctggcgggcaactgaaaccttgcccggggctttacaccaagccgccccccaatgtgacacagagcctttgacctctctataaacacctgctttgcaggtcctcattaggcgcattcctttcctgaagagagcttccccaaaaacccttctgtatgtttcctccgagagagccctcctcnccccccctccccaggactccctgcacaaanaaccccgcctatccctccgcntcctttctctctctccaacntacttcctcccctcaccnnccaggcccccacacaaaccaccatttggtntacccctcatccctntctcttctcccccccatatttcttctctccccctccctgtccctcccccttcctaancttacttgccctcatttcaaatccngcaacntccccgcaacntcctcta

SEQ ID NO: 207 - DNA, 1118 bp, Homo sapiens
  misc_feature (2)..(2): n is a, c, g, or t
  misc_feature (4)..(5): n is a, c, g, or t
  misc_feature (703)..(703): n is a, c, g, or t
  misc_feature (790)..(790): n is a, c, g, or t
  misc_feature (794)..(794): n is a, c, g, or t
  misc_feature (796)..(796): n is a, c, g, or t
  misc_feature (807)..(807): n is a, c, g, or t
  misc_feature (812)..(812): n is a, c, g, or t
  misc_feature (815)..(815): n is a, c, g, or t
  misc_feature (831)..(831): n is a, c, g, or t
  misc_feature (838)..(838): n is a, c, g, or t
  misc_feature (859)..(859): n is a, c, g, or t
  misc_feature (877)..(877): n is a, c, g, or t
  misc_feature (948)..(948): n is a, c, g, or t
  misc_feature (950)..(951): n is a, c, g, or t
  misc_feature (965)..(965): n is a, c, g, or t
  misc_feature (973)..(973): n is a, c, g, or t
  misc_feature (978)..(978): n is a, c, g, or t
  misc_feature (981)..(981): n is a, c, g, or t
  misc_feature (988)..(988): n is a, c, g, or t
  misc_feature (991)..(991): n is a, c, g, or t
  misc_feature (995)..(996): n is a, c, g, or t
  misc_feature (1004)..(1004): n is a, c, g, or t
  misc_feature (1008)..(1008): n is a, c, g, or t
  misc_feature (1018)..(1018): n is a, c, g, or t
  misc_feature (1022)..(1022): n is a, c, g, or t
  misc_feature (1025)..(1027): n is a, c, g, or t
  misc_feature (1031)..(1031): n is a, c, g, or t
  misc_feature (1039)..(1040): n is a, c, g, or t
  misc_feature (1043)..(1043): n is a, c, g, or t
  misc_feature (1052)..(1052): n is a, c, g, or t
  misc_feature (1063)..(1064): n is a, c, g, or t
  misc_feature (1067)..(1067): n is a, c, g, or t
  misc_feature (1079)..(1079): n is a, c, g, or t
  misc_feature (1101)..(1101): n is a, c, g, or t
  misc_feature (1112)..(1112): n is a, c, g, or t
anannagagaaattactatgagaggatcgcatcaccatcaccatcacggatcctatttaggtgacactatagaatcgtcgacccacgcgttccggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcaaacgtggtgctctttgaagggatcctggccttctactcccangaggtacgagacctgttccagatgaagctttttgtggatacagatgcggacacccggctctcacgcaaaagtattaagggacatcancgananaggcagggatnttgancanatttttatctcagtanatttacnttcgtcaagcctgcctttgangaaattctgcttgccaanaaaaaaatatgctgatgtgatcatcccctaaaggtgcaaataatttggtgggccattaaacttcattgtgnannaaattcagaaattnttgaatgnagggnccntccaaanggnaaannaatgggtntttnaaaggttaancccnttnnncaanaggaaggnnttngaaatccanaaaaaggcccnnttnaacccgttttcnattggaacccaccccttttttnaaaaaaaaaanaaaggg

SEQ ID NO: 208 - DNA, 821 bp, Homo sapiens
  misc_feature (4)..(4): n is a, c, g, or t
  misc_feature (764)..(764): n is a, c, g, or t
  misc_feature (775)..(775): n is a, c, g, or t
  misc_feature (784)..(784): n is a, c, g, or t
ttanctatgagaggatcgcatcaccatcaccatcacggatcctatttaggtgacactatagaatcgtcgacccacgcgtccggagttttgcacgtggatcgccgttcgggtgggcgagatggagacagcccccaagccgggcaaggatgtcccgcccaagaaagacaaacttcagaccaagagaaagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgntcatgggaggnggtgggggnacatccggttttctccattctgaggcactggtttgct

SEQ ID NO: 209 - DNA, 850 bp, Homo sapiens
  misc_feature (652)..(654): n is a, c, g, or t
  misc_feature (656)..(656): n is a, c, g, or t
  misc_feature (658)..(661): n is a, c, g, or t
  misc_feature (664)..(666): n is a, c, g, or t
  misc_feature (802)..(802): n is a, c, g, or t
atagggaaatactatgagaggacgcatcccatcaccatcacggatcctatttaggtgacactatacaatcgtcgactctggaccttggctgtcactcagttcagaggggagcaaaattatgcgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggtttttttttatgctcatgaaattaaaaattcatttttatgannnanannnnaannnaaaaaaaaacgagcggccgctccctatagtgagtcgtattaagcttaattagctgagcttggactcctgttgatagatccagtaatgacctcagaactccatctggattttgtcagaacgctcggttgccgccggncgttttttattgtgagaatccagctagcttggcgagatttcaggagct

SEQ ID NO: 210 - DNA, 1239 bp, Homo sapiens
  misc_feature (889)..(889): n is a, c, g, or t
  misc_feature (927)..(927): n is a, c, g, or t
  misc_feature (968)..(968): n is a, c, g, or t
  misc_feature (977)..(977): n is a, c, g, or t
  misc_feature (987)..(987): n is a, c, g, or t
  misc_feature (1001)..(1001): n is a, c, g, or t
  misc_feature (1021)..(1021): n is a, c, g, or t
  misc_feature (1023)..(1023): n is a, c, g, or t
  misc_feature (1034)..(1034): n is a, c, g, or t
  misc_feature (1037)..(1037): n is a, c, g, or t
  misc_feature (1044)..(1045): n is a, c, g, or t
  misc_feature (1050)..(1050): n is a, c, g, or t
  misc_feature (1057)..(1057): n is a, c, g, or t
  misc_feature (1068)..(1068): n is a, c, g, or t
  misc_feature (1072)..(1072): n is a, c, g, or t
  misc_feature (1082)..(1082): n is a, c, g, or t
  misc_feature (1100)..(1100): n is a, c, g, or t
  misc_feature (1106)..(1106): n is a, c, g, or t
  misc_feature (1113)..(1113): n is a, c, g, or t
  misc_feature (1115)..(1115): n is a, c, g, or t
  misc_feature (1119)..(1120): n is a, c, g, or t
  misc_feature (1130)..(1130): n is a, c, g, or t
  misc_feature (1140)..(1140): n is a, c, g, or t
  misc_feature (1145)..(1145): n is a, c, g, or t
  misc_feature (1148)..(1148): n is a, c, g, or t
  misc_feature (1151)..(1151): n is a, c, g, or t
  misc_feature (1158)..(1158): n is a, c, g, or t
  misc_feature (1166)..(1166): n is a, c, g, or t
  misc_feature (1168)..(1168): n is a, c, g, or t
  misc_feature (1186)..(1186): n is a, c, g, or t
  misc_feature (1191)..(1191): n is a, c, g, or t
  misc_feature (1196)..(1196): n is a, c, g, or t
  misc_feature (1199)..(1199): n is a, c, g, or t
  misc_feature (1204)..(1204): n is a, c, g, or t
  misc_feature (1209)..(1210): n is a, c, g, or t
  misc_feature (1216)..(1216): n is a, c, g, or t
  misc_feature (1219)..(1219): n is a, c, g, or t
  misc_feature (1223)..(1223): n is a, c, g, or t
  misc_feature (1226)..(1226): n is a, c, g, or t
tagagaaattactatgagaggatcgcatcaccatcaccatcacggatcctatttaggtgacactatagaatcgtcgacccacgcgtccggcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaccgttggacacaccgttgagcggccgctccctatagtgagtcgtattaagcttaattagctgagcttggactcctgttgatagatccagtaatgacctcagaactccatctggatttgttcagaacgctcggttgccgccgggcgttttttattggtgagaatccaagctagcttggcgagattttcaggagctaaggaagctaaaatggagaaaaaaatcactggatataccaccgttgatatatcccaatggcatcgtaaagaacattttgaggcatttcagtcagttgctcaatgtacctataacnagaccgttcagctggatattacggcctttttaaagacngtaaagaaaaataagcacaagttttatccggcctttattcncattcttgncccccctgangaatgctcatccgnaattcctatggcaatgaaananggggaactggngantggaaanngttcnccttgtnacccgttttcntgancaaactgaangtttttctcccttggagngaaacnccaaaantncggnngttttaaaanattccaaatnggggntanggnaaactgnctattccnanggttttgaaaaatttttnccccncccanccnggggnttccnntttttnaanggcnaangaaaaatttcccc

SEQ ID NO: 211 - DNA, 1183 bp, Homo sapiens
  misc_feature (1)..(1): n is a, c, g, or t
  misc_feature (15)..(15): n is a, c, g, or t
  misc_feature (921)..(921): n is a, c, g, or t
  misc_feature (927)..(927): n is a, c, g, or t
  misc_feature (964)..(964): n is a, c, g, or t
  misc_feature (976)..(976): n is a, c, g, or t
  misc_feature (992)..(992): n is a, c, g, or t
  misc_feature (999)..(999): n is a, c, g, or t
  misc_feature (1007)..(1007): n is a, c, g, or t
  misc_feature (1015)..(1017): n is a, c, g, or t
  misc_feature (1024)..(1024): n is a, c, g, or t
  misc_feature (1035)..(1035): n is a, c, g, or t
  misc_feature (1044)..(1044): n is a, c, g, or t
  misc_feature (1060)..(1060): n is a, c, g, or t
  misc_feature (1066)..(1066): n is a, c, g, or t
  misc_feature (1068)..(1068): n is a, c, g, or t
  misc_feature (1072)..(1072): n is a, c, g, or t
  misc_feature (1076)..(1076): n is a, c, g, or t
  misc_feature (1081)..(1081): n is a, c, g, or t
  misc_feature (1088)..(1088): n is a, c, g, or t
  misc_feature (1097)..(1098): n is a, c, g, or t
  misc_feature (1102)..(1102): n is a, c, g, or t
  misc_feature (1105)..(1105): n is a, c, g, or t
  misc_feature (1118)..(1118): n is a, c, g, or t
  misc_feature (1125)..(1125): n is a, c, g, or t
  misc_feature (1129)..(1129): n is a, c, g, or t
  misc_feature (1136)..(1136): n is a, c, g, or t
  misc_feature (1139)..(1139): n is a, c, g, or t
  misc_feature (1155)..(1155): n is a, c, g, or t
  misc_feature (1160)..(1160): n is a, c, g, or t
  misc_feature (1168)..(1168): n is a, c, g, or t
  misc_feature (1177)..(1177): n is a, c, g, or t
  misc_feature (1179)..(1181): n is a, c, g, or t
  misc_feature (1183)..(1183): n is a, c, g, or t
naatagagaaattanctatgagaggatcgcatcaccatcaccatcacggatcctatttaggtgacactatagaatcgtcgacccacgcgtccgaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccncacggnttaatgctgcagcaacaccgactgcttcatcttcccnggtgctccacgnggcttcctacctctcncgccttngttcctgnttgaaggnnncctcccnccttattaacnctgaatcanggttcaaaaaagcccncaggcntnctgnccanggggngtttccnccagcctanntggnccnccccccccccttnggggccnaggnataccgncantacaaattttcctgcnaaggncaaaaggnagggaaaanannncn

SEQ ID NO: 212 - DNA, 1202 bp, Homo sapiens
  misc_feature (927)..(927): n is a, c, g, or t
  misc_feature (936)..(936): n is a, c, g, or t
  misc_feature (999)..(999): n is a, c, g, or t
  misc_feature (1001)..(1001): n is a, c, g, or t
  misc_feature (1015)..(1015): n is a, c, g, or t
  misc_feature (1024)..(1024): n is a, c, g, or t
  misc_feature (1034)..(1034): n is a, c, g, or t
  misc_feature (1044)..(1044): n is a, c, g, or t
  misc_feature (1056)..(1056): n is a, c, g, or t
  misc_feature (1065)..(1065): n is a, c, g, or t
  misc_feature (1068)..(1068): n is a, c, g, or t
  misc_feature (1070)..(1070): n is a, c, g, or t
  misc_feature (1079)..(1079): n is a, c, g, or t
  misc_feature (1081)..(1081): n is a, c, g, or t
  misc_feature (1083)..(1083): n is a, c, g, or t
  misc_feature (1130)..(1130): n is a, c, g, or t
  misc_feature (1139)..(1139): n is a, c, g, or t
  misc_feature (1158)..(1159): n is a, c, g, or t
  misc_feature (1172)..(1172): n is a, c, g, or t
  misc_feature (1176)..(1176): n is a, c, g, or t
  misc_feature (1188)..(1192): n is a, c, g, or t
  misc_feature (1195)..(1195): n is a, c, g, or t
  misc_feature (1197)..(1198): n is a, c, g, or t
tagagaaattactatgagaggatcgcatcaccatcaccatcacggatcctatttaggtgacactatagaatcgtcgacccacgcgtccgctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttgggggcctgatcttggcatggcaaaanacctggggnactgccactgttccccaggtacgtgtacatggagcccaaactgtgtgttcctgtggcatttgncnaatttttgttgaantcttatttnaaaatgttancaacttactngcattttttaanaaccaaaanaananctggtaacntntnggcctcaagcatttgttctttcttaaaatgaaaaaatgggaattagngcttaaagnaaactgcttaatttttttnntaaaaactaacgnggantttttaaatttnnnnnaanannaaaa

SEQ ID NO: 213 - DNA, 856 bp, Homo sapiens
  misc_feature (427)..(427): n is a, c, g, or t
  misc_feature (533)..(533): n is a, c, g, or t
  misc_feature (584)..(584): n is a, c, g, or t
  misc_feature (666)..(666): n is a, c, g, or t
  misc_feature (670)..(670): n is a, c, g, or t
  misc_feature (684)..(684): n is a, c, g, or t
  misc_feature (725)..(725): n is a, c, g, or t
  misc_feature (745)..(745): n is a, c, g, or t
  misc_feature (752)..(752): n is a, c, g, or t
  misc_feature (765)..(765): n is a, c, g, or t
  misc_feature (770)..(770): n is a, c, g, or t
  misc_feature (776)..(776): n is a, c, g, or t
  misc_feature (787)..(787): n is a, c, g, or t
  misc_feature (789)..(789): n is a, c, g, or t
  misc_feature (797)..(797): n is a, c, g, or t
  misc_feature (800)..(801): n is a, c, g, or t
  misc_feature (808)..(808): n is a, c, g, or t
  misc_feature (811)..(811): n is a, c, g, or t
  misc_feature (813)..(813): n is a, c, g, or t
  misc_feature (817)..(817): n is a, c, g, or t
  misc_feature (829)..(831): n is a, c, g, or t
  misc_feature (834)..(834): n is a, c, g, or t
  misc_feature (847)..(847): n is a, c, g, or t
  misc_feature (849)..(849): n is a, c, g, or t
  misc_feature (855)..(855): n is a, c, g, or t
tagagagattactatgagaggatcgcatcaccatcaccatcacggatcctatttaggtgacactatagaatcgtcgacccacgcgtccgccggaccgggacgcagagtctgcggacccggcgccgaggcggccacccgagacgcggcgcgcacgctccggcctgcgcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgangatgcatagggtgctctgggaggtgccttcccgccgccccctcccccgatcgaggaatcatttccccctgcgcctctggaggaggagatcttcccttccccgccgnctcctccggaggaggagggagggcctgaggcccccataccgcccccaccanagcccagggagaaggtgagcagtattgatttggagatcgactctctgtcctcactgctggatgacatgaccaagaatgatcntttnaaagcccgggtgtnatctggatatgtgcccccaccagtggccacttccatttcanttccaagtccagtaccaaancctgcanccgggggcaaaanacccntgcctnctttggaagtncnctttcagnttnncagcctntgncnaaantttcggccttcnnnctnaaagccaaaaaanantttccnt

SEQ ID NO: 214 - DNA, 942 bp, Homo sapiens
  misc_feature (1)..(2): n is a, c, g, or t
  misc_feature (690)..(690): n is a, c, g, or t
  misc_feature (699)..(699): n is a, c, g, or t
  misc_feature (711)..(711): n is a, c, g, or t
  misc_feature (727)..(727): n is a, c, g, or t
  misc_feature (747)..(747): n is a, c, g, or t
  misc_feature (755)..(755): n is a, c, g, or t
  misc_feature (757)..(757): n is a, c, g, or t
  misc_feature (764)..(764): n is a, c, g, or t
  misc_feature (768)..(768): n is a, c, g, or t
  misc_feature (784)..(784): n is a, c, g, or t
  misc_feature (791)..(791): n is a, c, g, or t
  misc_feature (797)..(797): n is a, c, g, or t
  misc_feature (799)..(799): n is a, c, g, or t
  misc_feature (808)..(808): n is a, c, g, or t
  misc_feature (810)..(811): n is a, c, g, or t
  misc_feature (813)..(813): n is a, c, g, or t
  misc_feature (824)..(824): n is a, c, g, or t
  misc_feature (829)..(829): n is a, c, g, or t
  misc_feature (839)..(839): n is a, c, g, or t
  misc_feature (857)..(858): n is a, c, g, or t
  misc_feature (874)..(874): n is a, c, g, or t
  misc_feature (877)..(878): n is a, c, g, or t
  misc_feature (893)..(893): n is a, c, g, or t
  misc_feature (920)..(920): n is a, c, g, or t
  misc_feature (924)..(924): n is a, c, g, or t
  misc_feature (930)..(931): n is a, c, g, or t
  misc_feature (937)..(937): n is a, c, g, or t
  misc_feature (939)..(939): n is a, c, g, or t
  misc_feature (942)..(942): n is a, c, g, or t
nnattagagaaattactatgagaggatcgcatcaccatcaccatcacggatcctatttaggtgacactatagaatcgtcgacccacgcgtccgcggacgcgtgggtcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaaggggttcgcaaggagcttgaagtaaatggcattgaattctanccccagaangaatttgatgangatttggaggataaanacggagaatgaccaaatccnggcagganancatgccntttngctgtgggtgggaaantgacaangggtancnaagtgaatngnnanaagggtcctcnggccnaaaaactccntggggggatccatccaanntggaaaaaacctcaancannggggaattttgcccnggctttccaaaacttttttccttccangaancccccnncccggnanccn

SEQ ID NO: 215 - DNA, 949 bp, Homo sapiens
  misc_feature (842)..(842): n is a, c, g, or t
  misc_feature (890)..(890): n is a, c, g, or t
  misc_feature (893)..(893): n is a, c, g, or t
  misc_feature (914)..(914): n is a, c, g, or t
  misc_feature (923)..(923): n is a, c, g, or t
  misc_feature (930)..(930): n is a, c, g, or t
  misc_feature (938)..(938): n is a, c, g, or t
tagagaaattactatgagaggatcgcatcaccatcaccatcacggatcctatttaggtgacactatagaatcgtcgacccacgcgtccgcccacgcgtccgcccacgcgtccgagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgnggacacaccgtccgtctccgggacgccctcgcaccccctggacaccanacnggactgttcccgacccggaanacgcggggnccacagncccccagntgacccctaat

SEQ ID NO: 216 - DNA, 1261 bp, Homo sapiens
  misc_feature (842)..(842): n is a, c, g, or t
  misc_feature (873)..(873): n is a, c, g, or t
  misc_feature (904)..(904): n is a, c, g, or t
  misc_feature (922)..(922): n is a, c, g, or t
  misc_feature (942)..(942): n is a, c, g, or t
  misc_feature (944)..(944): n is a, c, g, or t
  misc_feature (947)..(947): n is a, c, g, or t
  misc_feature (951)..(951): n is a, c, g, or t
  misc_feature (962)..(962): n is a, c, g, or t
  misc_feature (967)..(967): n is a, c, g, or t
  misc_feature (977)..(977): n is a, c, g, or t
  misc_feature (995)..(995): n is a, c, g, or t
  misc_feature (1003)..(1003): n is a, c, g, or t
  misc_feature (1008)..(1008): n is a, c, g, or t
  misc_feature (1020)..(1020): n is a, c, g, or t
  misc_feature (1041)..(1041): n is a, c, g, or t
  misc_feature (1079)..(1079): n is a, c, g, or t
  misc_feature (1083)..(1083): n is a, c, g, or t
  misc_feature (1088)..(1088): n is a, c, g, or t
  misc_feature (1092)..(1093): n is a, c, g, or t
  misc_feature (1101)..(1101): n is a, c, g, or t
  misc_feature (1105)..(1105): n is a, c, g, or t
  misc_feature (1108)..(1109): n is a, c, g, or t
  misc_feature (1118)..(1118): n is a, c, g, or t
  misc_feature (1151)..(1151): n is a, c, g, or t
  misc_feature (1166)..(1166): n is a, c, g, or t
  misc_feature (1176)..(1176): n is a, c, g, or t
  misc_feature (1198)..(1198): n is a, c, g, or t
  misc_feature (1216)..(1216): n is a, c, g, or t
  misc_feature (1219)..(1219): n is a, c, g, or t
  misc_feature (1224)..(1225): n is a, c, g, or t
  misc_feature (1229)..(1229): n is a, c, g, or t
  misc_feature (1232)..(1232): n is a, c, g, or t
  misc_feature (1236)..(1236): n is a, c, g, or t
  misc_feature (1240)..(1240): n is a, c, g, or t
  misc_feature (1249)..(1249): n is a, c, g, or t
  misc_feature (1251)..(1251): n is a, c, g, or t
  misc_feature (1254)..(1254): n is a, c, g, or t
ctattagagaaattactatgagaggatcgcatcaccatcaccatcacggatcctatttaggtgacactatagaatcgtcgacccacgcgtccggcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccnaaaattttccagtgcccctgaaaaatagtcncaaggcactttaaagcattgttgaggtcatnggtaggtcttccaggaanagttgcttttccagtacccnanacnctanatatctagtanatggnacaaagcccnatgcgggaagtggagganatttctantgaanatgatgacctgntaaaaaaaaaaaacccccacnaaaaaaggtccctgccaaaaagaaactggaaatggagnactntcccncctnntgggcaancccnttnncccattttnagtctacggaaccccccccttcaaaattggccnaaaaaacccaactgntttctgaaanctgggaaagggttttggggccntttaacccaaaacttggnccnaatcnnccanttntgangganaaaaaaatntnttnaaagaaa

SEQ ID NO: 217 - DNA, 764 bp, Homo sapiens
  misc_feature (1)..(3): n is a, c, g, or t
  misc_feature (739)..(739): n is a, c, g, or t
nnnccatagagaaatactatgagaggatgcatcccatcaccatcacggatcctatttaggtgacactatagaatcgtcgactctggaccttggctgtcactcagtttatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcccatagacccgtgggcgtcgtggacttcccccgcaccgaggccgggcacctggcaggcactgtgcatcctcagctgcaggaccgagacttccagccactgcagcctggtgctccatcttccagatgttcagtggggaggacctgctctatgagggagagtccacggtgtaccccgtgttcattaacgaagctgctactatgagaagggcgttgcctttgtcaaactganaagtcacattcccgtgcctgcatgc

SEQ ID NO: 218 - DNA, 816 bp, Homo sapiens
  misc_feature (692)..(692): n is a, c, g, or t
  misc_feature (749)..(749): n is a, c, g, or t
  misc_feature (786)..(786): n is a, c, g, or t
  misc_feature (815)..(816): n is a, c, g, or t
gatactatgagaggtcgcatcccatcaccatcacggatcctatttaggtgacactatagaatcgtcgactctggaccttggctgtcactcagttccctgcctggcgactctccccctgcagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccancccacctaatccctcgacgaccgagcccctatgaaaagaccagaaaccaaagatccnagagctcattgatgagatgcggaagaaagagatgctncgaaagttttctataaatggggaagatann

SEQ ID NO: 219 - DNA, 932 bp, Homo sapiens
cgcatcaccatcaccatcacggatcctatttaggtgacactatagaatcgtcgacccacgcgtccggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctgtccactgtggtttcagccggtgcattatttcagctgtggctttcagaagaatgggaatgctgcgctgattttagccagccactggcccagctgaaatgatgggg

SEQ ID NO: 220 - DNA, 1279 bp, Homo sapiens
  misc_feature (876)..(876): n is a, c, g, or t
  misc_feature (946)..(946): n is a, c, g, or t
  misc_feature (951)..(951): n is a, c, g, or t
  misc_feature (955)..(955): n is a, c, g, or t
  misc_feature (959)..(959): n is a, c, g, or t
  misc_feature (985)..(985): n is a, c, g, or t
  misc_feature (994)..(995): n is a, c, g, or t
  misc_feature (997)..(997): n is a, c, g, or t
  misc_feature (1009)..(1009): n is a, c, g, or t
  misc_feature (1015)..(1015): n is a, c, g, or t
  misc_feature (1021)..(1021): n is a, c, g, or t
  misc_feature (1036)..(1036): n is a, c, g, or t
  misc_feature (1062)..(1062): n is a, c, g, or t
  misc_feature (1071)..(1071): n is a, c, g, or t
  misc_feature (1092)..(1092): n is a, c, g, or t
  misc_feature (1099)..(1099): n is a, c, g, or t
  misc_feature (1103)..(1103): n is a, c, g, or t
  misc_feature (1120)..(1120): n is a, c, g, or t
  misc_feature (1125)..(1125): n is a, c, g, or t
  misc_feature (1127)..(1127): n is a, c, g, or t
  misc_feature (1146)..(1146): n is a, c, g, or t
  misc_feature (1150)..(1150): n is a, c, g, or t
  misc_feature (1164)..(1164): n is a, c, g, or t
  misc_feature (1177)..(1178): n is a, c, g, or t
  misc_feature (1186)..(1186): n is a, c, g, or t
  misc_feature (1189)..(1191): n is a, c, g, or t
  misc_feature (1194)..(1194): n is a, c, g, or t
  misc_feature (1196)..(1196): n is a, c, g, or t
  misc_feature (1200)..(1200): n is a, c, g, or t
  misc_feature (1204)..(1206): n is a, c, g, or t
  misc_feature (1216)..(1216): n is a, c, g, or t
  misc_feature (1218)..(1218): n is a, c, g, or t
  misc_feature (1222)..(1222): n is a, c, g, or t
  misc_feature (1234)..(1234): n is a, c, g, or t
  misc_feature (1238)..(1238): n is a, c, g, or t
  misc_feature (1243)..(1243): n is a, c, g, or t
  misc_feature (1248)..(1248): n is a, c, g, or t
  misc_feature (1254)..(1254): n is a, c, g, or t
  misc_feature (1257)..(1257): n is a, c, g, or t
  misc_feature (1260)..(1260): n is a, c, g, or t
  misc_feature (1270)..(1270): n is a, c, g, or t
  misc_feature (1274)..(1274): n is a, c, g, or t
aatagagagattactatgagaggatcgcatcaccatcaccatcacggatcctatttaggtgacactatagaatcgtcgacccacgcgtccgcccacgcgtccgcagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaaagaaccatgggtggacccgaactccccggtgctcttggaggacccagtcctttgtgccttggcaaaaagcacaagcgaaccccagcccctgattgncctgcgctaccaactgcagcgtggggttgtggtcctggccaaaagctaccatgagcagcgcatcaaacanaacgngcangtgnttgaattccagttgacttccgaaganatgaagccnnanatggcctaacanaaatgngcgaanttttgacccttgaanttttggcgggcccccctaattatccnttttcggangaaaattaacatggaaggccntgcttgnggcngcccaaaagccctgcgngggangngaacccaagaaaggccctngcgnggggacgggaccanccccccgggtaanncccccgcnggnnnctncngaancctnnnctaacccccncncggnaaaaaaaaaaantttnttttnttttnaaaaanaangcncccccaaaanttcncccaa

SEQ ID NO: 221 - DNA, 1303 bp, Homo sapiens
  misc_feature (831)..(831): n is a, c, g, or t
  misc_feature (857)..(857): n is a, c, g, or t
  misc_feature (977)..(977): n is a, c, g, or t
  misc_feature (980)..(980): n is a, c, g, or t
  misc_feature (1029)..(1029): n is a, c, g, or t
  misc_feature (1033)..(1033): n is a, c, g, or t
  misc_feature (1079)..(1079): n is a, c, g, or t
  misc_feature (1098)..(1098): n is a, c, g, or t
  misc_feature (1106)..(1106): n is a, c, g, or t
  misc_feature (1109)..(1109): n is a, c, g, or t
  misc_feature (1114)..(1114): n is a, c, g, or t
  misc_feature (1123)..(1123): n is a, c, g, or t
  misc_feature (1138)..(1138): n is a, c, g, or t
  misc_feature (1147)..(1148): n is a, c, g, or t
  misc_feature (1153)..(1153): n is a, c, g, or t
  misc_feature (1163)..(1163): n is a, c, g, or t
  misc_feature (1174)..(1174): n is a, c, g, or t
  misc_feature (1178)..(1178): n is a, c, g, or t
  misc_feature (1181)..(1181): n is a, c, g, or t
  misc_feature (1186)..(1186): n is a, c, g, or t
  misc_feature (1190)..(1190): n is a, c, g, or t
  misc_feature (1198)..(1198): n is a, c, g, or t
  misc_feature (1200)..(1200): n is a, c, g, or t
  misc_feature (1209)..(1209): n is a, c, g, or t
  misc_feature (1214)..(1214): n is a, c, g, or t
  misc_feature (1216)..(1216): n is a, c, g, or t
  misc_feature (1227)..(1227): n is a, c, g, or t
  misc_feature (1230)..(1230): n is a, c, g, or t
  misc_feature (1232)..(1232): n is a, c, g, or t
  misc_feature (1254)..(1254): n is a, c, g, or t
  misc_feature (1256)..(1257): n is a, c, g, or t
  misc_feature (1270)..(1271): n is a, c, g, or t
  misc_feature (1280)..(1281): n is a, c, g, or t
  misc_feature (1289)..(1289): n is a, c, g, or t
  misc_feature (1291)..(1294): n is a, c, g, or t
  misc_feature (1299)..(1299): n is a, c, g, or t
aatagagaaattactatgagaggatcgcatcaccatcaccatcacggatcctatttaggtgacactatagaatcgtcgacccacgcgtccgcccacgcgtccggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcanaagcagcaaacctcctagcgctcccnttgccttcctcagctgcctcctgcgcccctgtgcccgactgactggagggaggcctgtcccaattctgcccgctccatggaaaaacgggcttgactgcattgccgctgtataaagcatgnggncttatagtgtttggacagctgaaaaattaatcccttctttggaaaaacntttntatgggacatttttcctccccttaaaaaccctgcaaatttttactnggagggaggatccccttcngggggttnacnggaangcttggggnggggggaaaaatcangaagaaaannaaaantccccctgcntggaaaaggantttnaantctgncctnaggaaaantncccaaaagnagggntncggaacccccnccnanggaaaagggggggaagccaaangnnacccccccccccnnggggaaacnnttaaaaangnnnnttttnggaa

SEQ ID NO: 222 - DNA, 1134 bp, Homo sapiens
  misc_feature (933)..(933): n is a, c, g, or t
  misc_feature (962)..(962): n is a, c, g, or t
  misc_feature (977)..(977): n is a, c, g, or t
  misc_feature (980)..(980): n is a, c, g, or t
  misc_feature (1005)..(1005): n is a, c, g, or t
  misc_feature (1021)..(1021): n is a, c, g, or t
  misc_feature (1039)..(1039): n is a, c, g, or t
  misc_feature (1062)..(1062): n is a, c, g, or t
  misc_feature (1074)..(1074): n is a, c, g, or t
  misc_feature (1089)..(1089): n is a, c, g, or t
  misc_feature (1093)..(1093): n is a, c, g, or t
  misc_feature (1096)..(1096): n is a, c, g, or t
  misc_feature (1099)..(1099): n is a, c, g, or t
  misc_feature (1103)..(1104): n is a, c, g, or t
  misc_feature (1106)..(1106): n is a, c, g, or t
  misc_feature (1110)..(1110): n is a, c, g, or t
  misc_feature (1112)..(1113): n is a, c, g, or t
  misc_feature (1117)..(1117): n is a, c, g, or t
  misc_feature (1124)..(1124): n is a, c, g, or t
tagagaaattactatgagaggatcgcatcaccatcaccatcacggatcctatttaggtgacactatagaatcgtcgacccacgcgtccggttatcatcaacaagaccagcagcaccagaattcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccnagcacctcctacctgtgtctccaacgcancacttttcccatganaanatgatgtggcaacccagtttgggcnaaatgaccctgaaccnggcagtccctcggggganaactcctgaacccccatcagggnctggtctacccnatcctccctttggcnaaanccnggnccannancccnanntttngtaatcnccttttaaag

SEQ ID NO: 223 - DNA, 1095 bp, Homo sapiens
  misc_feature (810)..(810): n is a, c, g, or t
  misc_feature (839)..(839): n is a, c, g, or t
  misc_feature (850)..(850): n is a, c, g, or t
  misc_feature (856)..(856): n is a, c, g, or t
  misc_feature (916)..(916): n is a, c, g, or t
  misc_feature (930)..(930): n is a, c, g, or t
  misc_feature (964)..(964): n is a, c, g, or t
  misc_feature (967)..(967): n is a, c, g, or t
  misc_feature (995)..(995): n is a, c, g, or t
  misc_feature (1005)..(1005): n is a, c, g, or t
  misc_feature (1007)..(1007): n is a, c, g, or t
  misc_feature (1011)..(1011): n is a, c, g, or t
  misc_feature (1015)..(1015): n is a, c, g, or t
  misc_feature (1043)..(1043): n is a, c, g, or t
  misc_feature (1052)..(1052): n is a, c, g, or t
  misc_feature (1067)..(1067): n is a, c, g, or t
  misc_feature (1069)..(1070): n is a, c, g, or t
  misc_feature (1073)..(1073): n is a, c, g, or t
  misc_feature (1076)..(1076): n is a, c, g, or t
  misc_feature (1082)..(1082): n is a, c, g, or t
  misc_feature (1088)..(1088): n is a, c, g, or t
  misc_feature (1090)..(1090): n is a, c, g, or t
  misc_feature (1092)..(1092): n is a, c, g, or t
  misc_feature (1094)..(1095): n is a, c, g, or t
tagagaaattactatgagaggatcgcatcaccatcaccatcacggatcctatttaggtgacactatagaatcgtcgacccacgcgtccgcccacgcgtccgcccacgcgtccggcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcangcccgcggtcaggctggtggacgccgtangggacgctaancctcancccgttgattcctgggtctagcttgcatgcctgggcccaggcccagcctcttgttcttanggcttggatcgtgnaaaaaggccaccctgaacaaatcgtgccgtgganctngaaccccctggcggcaggggttggcacncctcccccancnaacntganttggggaaaccttctgcccccaacccantcccccatntaataaatcctaagncnnaantantgttantgaaangngntnn

SEQ ID NO: 224 - DNA, 898 bp, Homo sapiens
  misc_feature (827)..(827): n is a, c, g, or t
  misc_feature (855)..(855): n is a, c, g, or t
agatactatgagaggatcgcatcaccatcaccatcacggatcctatttaggtgacactatagaatcgtcgactctggaccttggctgtcactcagttgggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacnatgacatcggagccgtctcaccacaggncatggggaagcatcctgaaggtgaactggctagactcacctgt

SEQ ID NO: 225 - DNA, 850 bp, Homo sapiens
  misc_feature (823)..(823): n is a, c, g, or t
  misc_feature (828)..(850): n is a, c, g, or t
tagagagaattactatgagaggatcgcatcaccatcaccatcacggatcctatttaggtgacactatagaatcgtcgacccacgcgtccggacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacngatcnnnnnnnnnnnnnnnnnnnnnnn

SEQ ID NO: 226 - DNA, 1196 bp, Homo sapiens
  misc_feature (898)..(898): n is a, c, g, or t
  misc_feature (914)..(914): n is a, c, g, or t
  misc_feature (922)..(922): n is a, c, g, or t
  misc_feature (926)..(926): n is a, c, g, or t
  misc_feature (962)..(962): n is a, c, g, or t
  misc_feature (979)..(979): n is a, c, g, or t
  misc_feature (986)..(986): n is a, c, g, or t
  misc_feature (992)..(992): n is a, c, g, or t
  misc_feature (1001)..(1001): n is a, c, g, or t
  misc_feature (1006)..(1006): n is a, c, g, or t
  misc_feature (1027)..(1028): n is a, c, g, or t
  misc_feature (1035)..(1035): n is a, c, g, or t
  misc_feature (1044)..(1045): n is a, c, g, or t
  misc_feature (1052)..(1052): n is a, c, g, or t
  misc_feature (1071)..(1071): n is a, c, g, or t
  misc_feature (1077)..(1077): n is a, c, g, or t
  misc_feature (1096)..(1097): n is a, c, g, or t
  misc_feature (1107)..(1107): n is a, c, g, or t
  misc_feature (1115)..(1115): n is a, c, g, or t
  misc_feature (1119)..(1119): n is a, c, g, or t
  misc_feature (1126)..(1126): n is a, c, g, or t
  misc_feature (1130)..(1130): n is a, c, g, or t
  misc_feature (1132)..(1133): n is a, c, g, or t
  misc_feature (1142)..(1142): n is a, c, g, or t
  misc_feature (1145)..(1145): n is a, c, g, or t
  misc_feature (1147)..(1147): n is a, c, g, or t
  misc_feature (1153)..(1153): n is a, c, g, or t
  misc_feature (1155)..(1155): n is a, c, g, or t
  misc_feature (1159)..(1159): n is a, c, g, or t
  misc_feature (1167)..(1167): n is a, c, g, or t
  misc_feature (1175)..(1175): n is a, c, g, or t
  misc_feature (1177)..(1177): n is a, c, g, or t
  misc_feature (1183)..(1183): n is a, c, g, or t
agagaaattactatgagaggatcgcatcaccatcaccatcacggatcctatttaggtgacactatagaatcgtcgacccacgcgtccggccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaaagtagtgagttaaagctacaggtcagtttatgaaacagaaaagtaggaatgcnttttctgggtgaaaantcacaccnttantgctataactctcctgcccatgatagtgtattctgntttcaggcaagcttatnctttccntctttncatttaaanattgncattacaatcttaccaggttnntttaaancttggtttnntccactntaaaccccattttgaaaantcaagntacgggaaactccttgttnnccttgtttcntaacttgnaagnaaaaatngatncnntttccatgnccnanccctgncntggntttttttngaaggttntntaaaanttacttttttttt

SEQ ID NO: 227 - DNA, 1410 bp, Homo sapiens
  misc_feature (1)..(1): n is a, c, g, or t
  misc_feature (10)..(12): n is a, c, g, or t
  misc_feature (812)..(812): n is a, c, g, or t
  misc_feature (906)..(906): n is a, c, g, or t
  misc_feature (942)..(942): n is a, c, g, or t
  misc_feature (1327)..(1327): n is a, c, g, or t
  misc_feature (1337)..(1339): n is a, c, g, or t
  misc_feature (1343)..(1343): n is a, c, g, or t
  misc_feature (1389)..(1389): n is a, c, g, or t
  misc_feature (1405)..(1406): n is a, c, g, or t
nggcccggcnnncgagagatactagagaggatcgcatcaccatcaccatcacggtcgacccacgcgtccgggctacattcccattcctgtgctccatgaaggcgctgagaaccggcaggtgcaccctttccatgtctatccccagcctgggatgcagcgattccgaactgaggcggcagcagcggcccctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcccatgacccatcgagaaactgcacctgtttcccagcctgaaaacaaaccagaaagtaagccaggcccagttggaccagaactccctcctggacacatcccaattncagtgatccgcaaagaggtggattctaaacctgtttcccagaagcccccacctccctctgagaaggtagaggtgaaagttccccctgctccagntccttgtcctcctccagccctggcccttctgctgtnccctcttcccccagagtgtggctacagaagagagggcagcccccagcactgcccctgcagaaactacacctcaaaaccaggagagccgaagctcccccaaacatccagagtgctgaaagtgaaagcatcctggaaaaggaacgggcctgagcaggtggaaccacttgaaggaaaaaactgacaaaatactgatgaccaagatatttaacaagactgcggcctgattcagggacccaaggacacccatggtcccagcaagaaaagggtcagaagtcaaactctggaaaatgaagaaacctggtcccggtagcccgcttgatcaccccacctgaaaatccctgggcatgtaaaggggcggacaaaggaaaaagggatgtaatccccnaacctcaaannncggnttcccgaggaagcctgccccccctcgaaaaacagatggtgattgtntaataatttttttttnnggga

SEQ ID NO: 228 - DNA, 1048 bp, Homo sapiens
  misc_feature (1)..(1): n is a, c, g, or t
  misc_feature (692)..(692): n is a, c, g, or t
  misc_feature (744)..(744): n is a, c, g, or t
  misc_feature (759)..(759): n is a, c, g, or t
  misc_feature (801)..(801): n is a, c, g, or t
  misc_feature (806)..(806): n is a, c, g, or t
  misc_feature (848)..(848): n is a, c, g, or t
  misc_feature (864)..(864): n is a, c, g, or t
  misc_feature (880)..(880): n is a, c, g, or t
  misc_feature (882)..(882): n is a, c, g, or t
  misc_feature (891)..(891): n is a, c, g, or t
  misc_feature (895)..(895): n is a, c, g, or t
  misc_feature (905)..(905): n is a, c, g, or t
  misc_feature (928)..(929): n is a, c, g, or t
  misc_feature (938)..(938): n is a, c, g, or t
  misc_feature (949)..(949): n is a, c, g, or t
  misc_feature (956)..(956): n is a, c, g, or t
  misc_feature (962)..(962): n is a, c, g, or t
  misc_feature (964)..(964): n is a, c, g, or t
  misc_feature (976)..(976): n is a, c, g, or t
  misc_feature (978)..(978): n is a, c, g, or t
  misc_feature (981)..(981): n is a, c, g, or t
  misc_feature (990)..(990): n is a, c, g, or t
  misc_feature (993)..(994): n is a, c, g, or t
  misc_feature (997)..(998): n is a, c, g, or t
  misc_feature (1003)..(1003): n is a, c, g, or t
  misc_feature (1020)..(1022): n is a, c, g, or t
  misc_feature (1028)..(1028): n is a, c, g, or t
  misc_feature (1035)..(1035): n is a, c, g, or t
  misc_feature (1041)..(1041): n is a, c, g, or t
  misc_feature (1048)..(1048): n is a, c, g, or t
natatagagaaattactatgagaggatcgcatcaccatcaccatcacggatcctatttaggtgacactatagaatcgtcgacccacgcgtccgagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcantggggtcaagagcctgcacacatgagccttccgggctggaaggctggcgtangacttggggctgtancatcatcttcctgaccctggcacctgtgtctacttgctcccnaaaanaggagcgctcatgtctttttttgcaccccaagttggctggancatcggccaccccaanattcatctgtgacctncnaggcattantctntgctcaaaantctctgggacggaactgctggcnnctttctgcnaaaaaaaaaanattttgnaaggcncnttcttaaaaaanancgngcctcaagnttnnttnnacttnaacgggaaaatgtaaannnccggantttcccntaagantgggggn

SEQ ID NO: 229 - DNA, 1149 bp, Homo sapiens
  misc_feature (859)..(859): n is a, c, g, or t
  misc_feature (875)..(875): n is a, c, g, or t
  misc_feature (899)..(899): n is a, c, g, or t
  misc_feature (909)..(909): n is a, c, g, or t
  misc_feature (943)..(943): n is a, c, g, or t
  misc_feature (957)..(957): n is a, c, g, or t
  misc_feature (964)..(964): n is a, c, g, or t
  misc_feature (988)..(988): n is a, c, g, or t
  misc_feature (1010)..(1010): n is a, c, g, or t
  misc_feature (1021)..(1021): n is a, c, g, or t
  misc_feature (1026)..(1026): n is a, c, g, or t
  misc_feature (1031)..(1031): n is a, c, g, or t
  misc_feature (1037)..(1037): n is a, c, g, or t
  misc_feature (1072)..(1072): n is a, c, g, or t
  misc_feature (1081)..(1081): n is a, c, g, or t
  misc_feature (1089)..(1089): n is a, c, g, or t
  misc_feature (1093)..(1094): n is a, c, g, or t
  misc_feature (1098)..(1098): n is a, c, g, or t
  misc_feature (1101)..(1101): n is a, c, g, or t
  misc_feature (1105)..(1105): n is a, c, g, or t
  misc_feature (1117)..(1117): n is a, c, g, or t
  misc_feature (1136)..(1137): n is a, c, g, or t
  misc_feature (1143)..(1146): n is a, c, g, or t
tagagaaattactatgagaggatcgcatcaccatcaccatcacggatcctatttaggtgacactatagaatcgtcgacccacgcgtccgtctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggncacaccggcggcccanagcccaggcctccagccagagtanagactctganggaggaggcgcccacagacttacgggtgtttganctgaactcggaaantgggaantctacaccctccaacaatggaaanaaaggctcagcccggacatcantgaggactggnaaaanacttnacttgnaatgactgaaaagaagggcaaatggcctttccaanggatgctcngggactgnaaanntaanggnagantggaatgagganccaaggacacctccccccnnggattnnnnctc

SEQ ID NO: 230 - DNA, 816 bp, Homo sapiens
  misc_feature (7)..(7): n is a, c, g, or t
  misc_feature (13)..(13): n is a, c, g, or t
  misc_feature (690)..(690): n is a, c, g, or t
  misc_feature (723)..(723): n is a, c, g, or t
  misc_feature (732)..(732): n is a, c, g, or t
  misc_feature (739)..(739): n is a, c, g, or t
  misc_feature (760)..(760): n is a, c, g, or t
  misc_feature (792)..(793): n is a, c, g, or t
  misc_feature (796)..(796): n is a, c, g, or t
  misc_feature (800)..(800): n is a, c, g, or t
  misc_feature (805)..(805): n is a, c, g, or t
  misc_feature (807)..(807): n is a, c, g, or t
  misc_feature (815)..(815): n is a, c, g, or t
tcttaangagganaattaactatgagaggatcgcatcaccatcaccatcacggatcctatttaggtgacactatagaatcgtcgacccacgcgtccggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagaagggacttttggccaaagaacgagagaacttaaagcgattaaaatgtctgcgacgataccgccngcgctatggagtggaagccttactgcataggcngttgaaggnaacgganaatgctggccacagatggtgnttgcccaacaggcccataccactcgttccagnncanaggngcttngnccttttgng

SEQ ID NO: 231 - DNA, 1114 bp, Homo sapiens
  misc_feature (858)..(858): n is a, c, g, or t
  misc_feature (860)..(861): n is a, c, g, or t
  misc_feature (863)..(869): n is a, c, g, or t
  misc_feature (871)..(876): n is a, c, g, or t
  misc_feature (899)..(899): n is a, c, g, or t
  misc_feature (910)..(910): n is a, c, g, or t
  misc_feature (913)..(913): n is a, c, g, or t
  misc_feature (918)..(918): n is a, c, g, or t
  misc_feature (953)..(953): n is a, c, g, or t
  misc_feature (974)..(974): n is a, c, g, or t
  misc_feature (978)..(978): n is a, c, g, or t
  misc_feature (1001)..(1002): n is a, c, g, or t
  misc_feature (1005)..(1005): n is a, c, g, or t
  misc_feature (1021)..(1021): n is a, c, g, or t
  misc_feature (1038)..(1038): n is a, c, g, or t
  misc_feature (1043)..(1043): n is a, c, g, or t
  misc_feature (1059)..(1060): n is a, c, g, or t
  misc_feature (1075)..(1075): n is a, c, g, or t
  misc_feature (1102)..(1103): n is a, c, g, or t
  misc_feature (1107)..(1107): n is a, c, g, or t
  misc_feature (1110)..(1110): n is a, c, g, or t
aaatagagaaattactatgagaggatcgcatcaccatcaccatcacggatcctatttaggtgacactatagaatcgtcgacccacgcgtccgccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggtcgcgccccactgcgctgctgaccttcctgcagttccagacacctcccacaataaagagctcctcctctgtaaaaaaaaaanannannnnnnnannnnnnaaagggcggccgctcccctatantgagtcttatnaancttanttaactgaacttggactccttgttgaaaaatccantaaatgacctcaaaatccatnttgnatttttttcaaaaacctcggttnnccnccggggcgtttttttntttggtgaaaatccaanctaanctttggcaaaattttnnggaacttaaggaacntaaaatggaaaaaaaaatccttggatnntccnccnttta

SEQ ID NO: 232 - DNA, 438 bp, Homo sapiens
gatagagagattactatgagaggatcgcatcaccatcaccatcacggatcctatttaggtgacactatagaatcgtcgacccacgcgtccgataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacaaactgtatgcaaactaataaaactattctgaag

SEQ ID NO: 233 - DNA, 885 bp, Homo sapiens
  misc_feature (686)..(686): n is a, c, g, or t
gatactatgagaggtcgcatcaccatcaccatcacggatcctatttaggtgacactatagaatcgtcgactctggaccttggctgtcactcagttactcaactaagaagccaggggagccaaaagtatgccctccgcagttttcagatggcccgggtgatcttcaaccaagacggctgctcagtcttacacaggcattccagggacacccacttctacccactggaggaaggaagtacatctttggatgatgaaaagccaaacccacgactgtcaaaggatattactcatttcctctagcatcataatgtaatgaaacacctgtaactggtgccgggtggtgtgcatggtagtaatggaggtgctgatgccatgaccatcactgttggtggccacccacatcccctagggtcactggccagctctgtgtgcccaatcccaattaagtgctttgacgttaaacgctggcacctgtgacctgatattggagccagtcatcccatatggagagccagcaaggtctgggagttctccgtcctcttggccaaggccgctgactgactgggctactagtcaaaagcccatctcccttgcctcaaggaatgacattctctgacgagtaaattatgctctagcactccctttcctctagatcggcctgaggctgggacattacatgaaatcacncccttgctgggcttaatccctttacctaccctcccatttatatactggtgtctctgggagcctttccttatgaacctcttatatctgagagaaataaaaaaaaactaaattagcggccgctcctatagtgagtcgaataagctcaatatctgacttggactctgttgatggatccatatgactcaaactcgtcagaatt

SEQ ID NO: 234 - DNA, 962 bp, Homo sapiens
  misc_feature (2)..(2): n is a, c, g, or t
  misc_feature (5)..(6): n is a, c, g, or t
  misc_feature (853)..(853): n is a, c, g, or t
  misc_feature (860)..(860): n is a, c, g, or t
  misc_feature (882)..(882): n is a, c, g, or t
  misc_feature (888)..(888): n is a, c, g, or t
  misc_feature (900)..(900): n is a, c, g, or t
  misc_feature (904)..(904): n is a, c, g, or t
  misc_feature (909)..(909): n is a, c, g, or t
  misc_feature (913)..(913): n is a, c, g, or t
  misc_feature (915)..(915): n is a, c, g, or t
  misc_feature (917)..(917): n is a, c, g, or t
  misc_feature (920)..(920): n is a, c, g, or t
  misc_feature (922)..(922): n is a, c, g, or t
  misc_feature (925)..(925): n is a, c, g, or t
  misc_feature (928)..(928): n is a, c, g, or t
  misc_feature (936)..(936): n is a, c, g, or t
  misc_feature (943)..(943): n is a, c, g, or t
  misc_feature (948)..(949): n is a, c, g, or t
  misc_feature (952)..(952): n is a, c, g, or t
ancanntagagaaattactatgagaggatcgcatcaccatcaccatcacggatcctatttaggtgacactatagaatcgtcgacccacgcgtccgcccacgcgtccgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgccccactgggtcacccacacgtcctactgcttctgaagcccgcactgccnccgctcntgccccaaaaaggttgtttaantttccncgtaaggcaggncccntttgngccncngnaangnccngcnggggggtnccccccnaaaanntcnggggcaaaaa

SEQ ID NO: 235 - DNA, 944 bp, Homo sapiens
  misc_feature (1)..(1): n is a, c, g, or t
  misc_feature (620)..(620): n is a, c, g, or t
  misc_feature (647)..(647): n is a, c, g, or t
  misc_feature (671)..(671): n is a, c, g, or t
  misc_feature (723)..(723): n is a, c, g, or t
  misc_feature (731)..(731): n is a, c, g, or t
  misc_feature (740)..(740): n is a, c, g, or t
  misc_feature (742)..(742): n is a, c, g, or t
  misc_feature (778)..(778): n is a, c, g, or t
  misc_feature (780)..(780): n is a, c, g, or t
  misc_feature (785)..(785): n is a, c, g, or t
  misc_feature (793)..(793): n is a, c, g, or t
  misc_feature (802)..(802): n is a, c, g, or t
  misc_feature (813)..(813): n is a, c, g, or t
  misc_feature (819)..(819): n is a, c, g, or t
  misc_feature (826)..(826): n is a, c, g, or t
  misc_feature (836)..(836): n is a, c, g, or t
  misc_feature (852)..(852): n is a, c, g, or t
  misc_feature (854)..(854): n is a, c, g, or t
  misc_feature (859)..(859): n is a, c, g, or t
  misc_feature (864)..(864): n is a, c, g, or t
  misc_feature (872)..(872): n is a, c, g, or t
  misc_feature (876)..(876): n is a, c, g, or t
  misc_feature (890)..(890): n is a, c, g, or t
  misc_feature (900)..(900): n is a, c, g, or t
  misc_feature (902)..(902): n is a, c, g, or t
  misc_feature (904)..(904): n is a, c, g, or t
  misc_feature (917)..(919): n is a, c, g, or t
  misc_feature (925)..(925): n is a, c, g, or t
  misc_feature (928)..(929): n is a, c, g, or t
  misc_feature (933)..(934): n is a, c, g, or t
  misc_feature (937)..(937): n is a, c, g, or t
naattagagaaattactatgagaggatcgcatcaccatcaccatcacggatcctatttaggtgacactatagaatcgtcgacccacgcgtccgcgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgctgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacganaagaaggtgggggccaaggctgcccancaggacagcgacagtgatggggangccctgggcggcaacccgatggtggcagggttccaggacgatgtggacctcnaaaaccanccacgtggnantcccccgctgccttgcaggccccgtcccaattcaananatcantcttttcnagtgaggangaaacaaaaantggcanctcccanaaaaggcctngccccaactccccaanantgctnaaaanccaaaaancaantggtcctccatacnactttcaaancnangaagggggaaaannntcccanaannaacnnaanaccccct

SEQ ID NO: 236 - DNA, 867 bp, Homo sapiens
tatgagaggtcgcatcaccatcaccatcacggatcctatttaggtgacactatagaatcgtcgacccacgcgtccggccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagcc

SEQ ID NO: 237 - DNA, 1176 bp, Homo sapiens
  misc_feature (1)..(1): n is a, c, g, or t
  misc_feature (908)..(908): n is a, c, g, or t
  misc_feature (947)..(947): n is a, c, g, or t
  misc_feature (970)..(970): n is a, c, g, or t
  misc_feature (974)..(974): n is a, c, g, or t
  misc_feature (982)..(982): n is a, c, g, or t
  misc_feature (994)..(995): n is a, c, g, or t
  misc_feature (997)..(997): n is a, c, g, or t
  misc_feature (999)..(999): n is a, c, g, or t
  misc_feature (1011)..(1011): n is a, c, g, or t
  misc_feature (1013)..(1013): n is a, c, g, or t
  misc_feature (1028)..(1028): n is a, c, g, or t
  misc_feature (1046)..(1046): n is a, c, g, or t
  misc_feature (1048)..(1048): n is a, c, g, or t
  misc_feature (1056)..(1056): n is a, c, g, or t
  misc_feature (1060)..(1060): n is a, c, g, or t
  misc_feature (1062)..(1062): n is a, c, g, or t
  misc_feature (1066)..(1066): n is a, c, g, or t
  misc_feature (1069)..(1069): n is a, c, g, or t
  misc_feature (1076)..(1076): n is a, c, g, or t
  misc_feature (1099)..(1099): n is a, c, g, or t
  misc_feature (1109)..(1109): n is a, c, g, or t
  misc_feature (1111)..(1111): n is a, c, g, or t
  misc_feature (1119)..(1119): n is a, c, g, or t
  misc_feature (1125)..(1125): n is a, c, g, or t
  misc_feature (1140)..(1140): n is a, c, g, or t
  misc_feature (1150)..(1151): n is a, c, g, or t
  misc_feature (1160)..(1160): n is a, c, g, or t
  misc_feature (1162)..(1162): n is a, c, g, or t
  misc_feature (1173)..(1174): n is a, c, g, or t
naattagagaaattactatgagaggatcgcatcaccatcaccatcacggatcctatttaggtgacactatagaatcgtcgacccacgcgtccgatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactggganaccgcgtcggcggcatcttccctggcctcagtggccgantacacaggtcccaagctctttanggancccagtantaattcaaacanncnantattcccaatgncntatcccattgctgcntggctggaaaagtgaacnancccccaanaatncntatngangaactgnaaaatgtgatgccaatccctacntcaactgttncnggagctgntgccanttcggggctttatgntcttcctganntgagaaatntnaaattcctggnngg

SEQ ID NO: 238 - DNA, 1348 bp, Homo sapiens
  misc_feature (1)..(1): n is a, c, g, or t
  misc_feature (793)..(793): n is a, c, g, or t
  misc_feature (805)..(805): n is a, c, g, or t
  misc_feature (1182)..(1182): n is a, c, g, or t
  misc_feature (1198)..(1198): n is a, c, g, or t
  misc_feature (1255)..(1255): n is a, c, g, or t
  misc_feature (1262)..(1262): n is a, c, g, or t
  misc_feature (1269)..(1270): n is a, c, g, or t
  misc_feature (1274)..(1274): n is a, c, g, or t
  misc_feature (1313)..(1313): n is a, c, g, or t
  misc_feature (1341)..(1342): n is a, c, g, or t
  misc_feature (1348)..(1348): n is a, c, g, or t
nggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagattaagggctgggaggccgtgagtatctaccagttccacggtcaggctactgctgaggactcagggaacagcagtgaccaggaaggcagggagttggagctggggcangtgcccctttcngctcctccattgcccccacggccagatctgccccccaggaagcccagaacggccgcgatccgcatgcgagctcgattacctgaacctggactcctgttgataaaatcagtaatgaccctcaaactccatctggatttgttcaaaaaccccggttggcccccgggcgttttttattgggaaaaatccaactacttagggaaaatttccggaactaggaaaccaaaaggaaaaaaaaacccacgaaaataccaccatgaaaaaacccaaggcctcaaaaaaaaattaaaggatttccacaaccattaagcacctaaaacagaccgtatacgaagattcccgcccttttaacccgtaaaaaaacacacacaaattacctnccctaaccccattcanccacaaaaaacagccccccaatttcatacacaaaaaacgaaacacgaataacccacnacccccntccacannactntaaaaaccacaaatccacaccgacaaaaaaaccacccancacataccaaaaccccactaaaaacgannaaacan

SEQ ID NO: 239 - DNA, 837 bp, Homo sapiens
  misc_feature (741)..(741): n is a, c, g, or t
agatactatgagaggtcgcatcccatcaccatcacggatcctatttaggtgacactatagaatcgtcgactctggaccttggctgtcactcagttgaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggaatatcctttctggagtctcggcaccattccctaaagctcaagccagacatatttgtgggtttacagtgacctttggcaagttgctaatccccctctatagcttaattttcccctctaaaatggcagtaatctatggccctttgtggatatgcggagtgatattggattagttgatactggacttatattttttcacacantatcattatattcctgaaaactttggtgtaaaacaataatgtcttaatagtcatttatattatgctttcaaaaatacaatatagctgtaattcttt

SEQ ID NO: 240 - DNA, 1195 bp, Homo sapiens
  misc_feature (960)..(960): n is a, c, g, or t
  misc_feature (965)..(965): n is a, c, g, or t
  misc_feature (976)..(976): n is a, c, g, or t
  misc_feature (1012)..(1012): n is a, c, g, or t
  misc_feature (1023)..(1023): n is a, c, g, or t
  misc_feature (1035)..(1035): n is a, c, g, or t
  misc_feature (1039)..(1039): n is a, c, g, or t
  misc_feature (1073)..(1073): n is a, c, g, or t
  misc_feature (1077)..(1077): n is a, c, g, or t
  misc_feature (1083)..(1083): n is a, c, g, or t
  misc_feature (1085)..(1085): n is a, c, g, or t
  misc_feature (1087)..(1087): n is a, c, g, or t
  misc_feature (1096)..(1096): n is a, c, g, or t
  misc_feature (1104)..(1104): n is a, c, g, or t
  misc_feature (1119)..(1119): n is a, c, g, or t
  misc_feature (1128)..(1128): n is a, c, g, or t
  misc_feature (1130)..(1130): n is a, c, g, or t
  misc_feature (1136)..(1136): n is a, c, g, or t
  misc_feature (1149)..(1149): n is a, c, g, or t
  misc_feature (1152)..(1152): n is a, c, g, or t
  misc_feature (1170)..(1170): n is a, c, g, or t
  misc_feature (1175)..(1176): n is a, c, g, or t
  misc_feature (1178)..(1178): n is a, c, g, or t
  misc_feature (1183)..(1183): n is a, c, g, or t
  misc_feature (1189)..(1190): n is a, c, g, or t
  misc_feature (1192)..(1192): n is a, c, g, or t
tagagaaattactatgagaggatcgcatcaccatcaccatcacggatcctatttaggtgacactatagaatcgtcgacccacgcgtccggggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtantaatngacatgtgccnagggcaatgatgaatgaaaatctaccccccaaatcnagcatcctgancaactcttgatnatcntattgagtcaatggtaggcatttcctatcactgnttcnttcaananancactacttnttttactnaacggatccaaaaanaaaattgcntngacccnactaatttcaaangcntttaataataatattttnaaaanncnccttntccccnngncgg

SEQ ID NO: 241 - DNA, 1241 bp, Homo sapiens
  misc_feature (1)..(1): n is a, c, g, or t
  misc_feature (828)..(828): n is a, c, g, or t
  misc_feature (911)..(911): n is a, c, g, or t
  misc_feature (922)..(922): n is a, c, g, or t
  misc_feature (932)..(932): n is a, c, g, or t
  misc_feature (936)..(936): n is a, c, g, or t
  misc_feature (953)..(953): n is a, c, g, or t
  misc_feature (964)..(964): n is a, c, g, or t
  misc_feature (977)..(977): n is a, c, g, or t
  misc_feature (985)..(985): n is a, c, g, or t
  misc_feature (996)..(996): n is a, c, g, or t
  misc_feature (1025)..(1025): n is a, c, g, or t
  misc_feature (1028)..(1028): n is a, c, g, or t
  misc_feature (1030)..(1030): n is a, c, g, or t
  misc_feature (1044)..(1044): n is a, c, g, or t
  misc_feature (1047)..(1047): n is a, c, g, or t
  misc_feature (1060)..(1060): n is a, c, g, or t
  misc_feature (1091)..(1091): n is a, c, g, or t
  misc_feature (1094)..(1094): n is a, c, g, or t
  misc_feature (1098)..(1098): n is a, c, g, or t
  misc_feature (1102)..(1102): n is a, c, g, or t
  misc_feature (1120)..(1122): n is a, c, g, or t
  misc_feature (1127)..(1127): n is a, c, g, or t
  misc_feature (1129)..(1129): n is a, c, g, or t
  misc_feature (1142)..(1142): n is a, c, g, or t
  misc_feature (1147)..(1147): n is a, c, g, or t
  misc_feature (1150)..(1150): n is a, c, g, or t
  misc_feature (1163)..(1163): n is a, c, g, or t
  misc_feature (1178)..(1178): n is a, c, g, or t
  misc_feature (1191)..(1192): n is a, c, g, or t
  misc_feature (1198)..(1198): n is a, c, g, or t
  misc_feature (1201)..(1201): n is a, c, g, or t
  misc_feature (1207)..(1207): n is a, c, g, or t
  misc_feature (1215)..(1215): n is a, c, g, or t
  misc_feature (1219)..(1219): n is a, c, g, or t
  misc_feature (1223)..(1223): n is a, c, g, or t
  misc_feature (1227)..(1228): n is a, c, g, or t
  misc_feature (1230)..(1230): n is a, c, g, or t
nttagagaaattactatgagaggatcgcatcaccatcaccatcacggatcctatttaggtgacactatagaatcgtcgacccacgcgtccggccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaanacagccgatcgccagtacatggagggcttcaacgacgagctggaagccttcaaggagcgtgtgcggggccgtgccaagctgcncatcgagaagncatgaaggantacnaggaggaggaccgcaanaagcggctcgncccggcggcctgnacccgtcnaggtctacaantccttccctgagaactccaaaatgcttcnatntnaagacttgcaaatnctncagaaccccttcncaaaatggaccccccgaccaaattacccatncancctncttnatttggccttggtcccannnttagncnccagccaagaggnaaaangcngtctgggaccttntgaacttttccaaanggcaaaaaagatnnttttanttnccattncccccctntttngccntttnncntttaaaaaaaa

SEQ ID NO: 242 - DNA, 865 bp, Homo sapiens
  misc_feature (753)..(753): n is a, c, g, or t
agagatactatgagaggtcgcatcaccatcaccatcacggatcctatttaggtgacactatagaatcgtcgactctggaccttggctgtcactcagttagtgttgtgatgcagccgaaaagaaaacattttattaaggatattcgtcatcttcctgtgaacagtaaggagtcccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccnagtttgataacattggcatgaatgccatggctaaacaagataatgcagtctcaacagcttaaatgggaggctgacgtgatgactggctaccacagagatgcaaagtatctca

SEQ ID NO: 243 - DNA, 978 bp, Homo sapiens
atgagaggtcgcatcaccatcaccatcacggatcctatttaggtgacactatagaatcgtcgacccacgcgtccgcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattccctttttttcttatgaaaaacgaactca

SEQ ID NO: 244 - DNA, 988 bp, Homo sapiens
  misc_feature (1)..(2): n is a, c, g, or t
  misc_feature (4)..(4): n is a, c, g, or t
  misc_feature (579)..(579): n is a, c, g, or t
  misc_feature (788)..(789): n is a, c, g, or t
  misc_feature (791)..(791): n is a, c, g, or t
  misc_feature (795)..(795): n is a, c, g, or t
  misc_feature (801)..(802): n is a, c, g, or t
  misc_feature (804)..(805): n is a, c, g, or t
  misc_feature (809)..(809): n is a, c, g, or t
  misc_feature (811)..(811): n is a, c, g, or t
  misc_feature (817)..(817): n is a, c, g, or t
  misc_feature (872)..(872): n is a, c, g, or t
  misc_feature (901)..(901): n is a, c, g, or t
  misc_feature (904)..(905): n is a, c, g, or t
  misc_feature (913)..(913): n is a, c, g, or t
  misc_feature (916)..(917): n is a, c, g, or t
  misc_feature (934)..(935): n is a, c, g, or t
  misc_feature (941)..(941): n is a, c, g, or t
  misc_feature (944)..(944): n is a, c, g, or t
  misc_feature (971)..(973): n is a, c, g, or t
  misc_feature (976)..(976): n is a, c, g, or t
  misc_feature (985)..(985): n is a, c, g, or t
nnantagagaaattactatgagaggatcgcatcaccatcaccatcacggatcctatttaggtgacactatagaatcgtcgacccacgcgtccgcacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcantggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgttnnanaaanttttannannttanantaatantaaaagggcggcccgctccctatagtgagtcgtattaagctttaattagcttgancttggaattcctgttgataaatcccagtnatnnacctccanaanntccatctgggatttttnnaaaacnctnggtttgcccccggggggtttttttttnnnganaatcccaancta

SEQ ID NO: 245 - DNA, 986 bp, Homo sapiens
  misc_feature (881)..(881): n is a, c, g, or t
  misc_feature (899)..(899): n is a, c, g, or t
  misc_feature (972)..(972): n is a, c, g, or t
tagagaaattactatgagaggatcgcatcaccatcaccatcacggatcctatttaggtgacactatagaatcgtcgacccacgcgtccggtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggccacaggagtagacagtgaattcaggtttancttcaccttagttatggngctcaccaaacgaagggtatcagctatttttttttaaattcaaaaaaaaatatcccttttatagttggggccntctgggagcaaaac

SEQ ID NO: 246 - DNA, 1177 bp, Homo sapiens
  misc_feature (866)..(866): n is a, c, g, or t
  misc_feature (992)..(992): n is a, c, g, or t
  misc_feature (994)..(994): n is a, c, g, or t
  misc_feature (1011)..(1011): n is a, c, g, or t
  misc_feature (1016)..(1016): n is a, c, g, or t
  misc_feature (1020)..(1020): n is a, c, g, or t
  misc_feature (1026)..(1027): n is a, c, g, or t
  misc_feature (1029)..(1029): n is a, c, g, or t
  misc_feature (1048)..(1048): n is a, c, g, or t
  misc_feature (1050)..(1050): n is a, c, g, or t
  misc_feature (1057)..(1057): n is a, c, g, or t
  misc_feature (1068)..(1068): n is a, c, g, or t
  misc_feature (1075)..(1075): n is a, c, g, or t
  misc_feature (1077)..(1077): n is a, c, g, or t
  misc_feature (1081)..(1081): n is a, c, g, or t
  misc_feature (1087)..(1087): n is a, c, g, or t
  misc_feature (1095)..(1095): n is a, c, g, or t
  misc_feature (1097)..(1097): n is a, c, g, or t
  misc_feature (1102)..(1102): n is a, c, g, or t
  misc_feature (1110)..(1110): n is a, c, g, or t
  misc_feature (1127)..(1128): n is a, c, g, or t
  misc_feature (1131)..(1131): n is a, c, g, or t
  misc_feature (1133)..(1133): n is a, c, g, or t
  misc_feature (1152)..(1152): n is a, c, g, or t
  misc_feature (1156)..(1156): n is a, c, g, or t
  misc_feature (1170)..(1170): n is a, c, g, or t
  misc_feature (1176)..(1176): n is a, c, g, or t
tagagaaattactatgagaggatcgcatcaccatcaccatcacggatcctatttaggtgacactatagaatcgtcgacccacgcgtccgctgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtttgaaaggangccccttccccttgtgaaggagggggcactcctctccagcccctggtaccacagtcctcacgaatggtgcagtgatttctagccaggcgtcaagatgcgctgcttttcctctcctgcctcatcccntngttggcagctccatttnagccntggnaagganntnatttttgggcttttttttntnaaacccncgggttttttnccccttnancccncctccnatttccantnttttnaaagggcnggggtgaaaaaccctgnnatntnaaaaaaaaaaaaagggggnttgntttttttgggtggnaaaaang

SEQ ID NO: 247 - DNA, 586 bp, Homo sapiens
  misc_feature (5)..(7): n is a, c, g, or t
  misc_feature (12)..(12): n is a, c, g, or t
  misc_feature (345)..(345): n is a, c, g, or t
  misc_feature (361)..(361): n is a, c, g, or t
  misc_feature (429)..(429): n is a, c, g, or t
  misc_feature (475)..(475): n is a, c, g, or t
  misc_feature (496)..(496): n is a, c, g, or t
  misc_feature (505)..(505): n is a, c, g, or t
  misc_feature (520)..(520): n is a, c, g, or t
  misc_feature (531)..(531): n is a, c, g, or t
  misc_feature (534)..(534): n is a, c, g, or t
  misc_feature (538)..(539): n is a, c, g, or t
  misc_feature (541)..(541): n is a, c, g, or t
  misc_feature (545)..(545): n is a, c, g, or t
  misc_feature (552)..(553): n is a, c, g, or t
  misc_feature (558)..(558): n is a, c, g, or t
  misc_feature (562)..(562): n is a, c, g, or t
  misc_feature (568)..(568): n is a, c, g, or t
  misc_feature (570)..(570): n is a, c, g, or t
  misc_feature (572)..(572): n is a, c, g, or t
  misc_feature (581)..(581): n is a, c, g, or t
aaaannnagganaataactatgagaggatcgcatcaccatcaccatcacggatcctatttaggtgacactatagaatcgtcgacccacgcgtccggcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccanatgaggagggatccanagggtgcccagatcctgcaggagcgtccccggatttcgacatccaccctcgacctgggcaagctccanagcctgccggaaggctccctcggtcgcgagtatctccgtttcctgnatgtgaacagggtctccccanacacccgancacccacccgcttcntggatgatganganctanngnatgngattcannggtancggnaggtgnananatgcttcanaccct

SEQ ID NO: 248 - DNA, 1047 bp, Homo sapiens
  misc_feature (11)..(11): n is a, c, g, or t
  misc_feature (909)..(909): n is a, c, g, or t
  misc_feature (934)..(934): n is a, c, g, or t
  misc_feature (940)..(940): n is a, c, g, or t
  misc_feature (944)..(944): n is a, c, g, or t
  misc_feature (956)..(956): n is a, c, g, or t
  misc_feature (964)..(964): n is a, c, g, or t
  misc_feature (976)..(976): n is a, c, g, or t
  misc_feature (982)..(982): n is a, c, g, or t
  misc_feature (984)..(984): n is a, c, g, or t
  misc_feature (999)..(999): n is a, c, g, or t
  misc_feature (1006)..(1007): n is a, c, g, or t
  misc_feature (1015)..(1015): n is a, c, g, or t
  misc_feature (1017)..(1018): n is a, c, g, or t
  misc_feature (1020)..(1020): n is a, c, g, or t
  misc_feature (1028)..(1028): n is a, c, g, or t
  misc_feature (1034)..(1035): n is a, c, g, or t
  misc_feature (1040)..(1040): n is a, c, g, or t
  misc_feature (1047)..(1047): n is a, c, g, or t
agaaattaacnatgagaggatcgcatcaccatcaccatcacggatcctatttaggtgacactatagaatcgtcgacccacgcgtccgagacagagcgcggacgccgcaggaggcagtgcctggaccccagctgcccaggagagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcacccccagttgtgcccccgctccactcccccaagtccccagtctggcccaccttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgacatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggccgggggttggggagccacacagggtgaacgggcagcagccggctccatgccccactgccctggctgatgagtccttcggtggcctcagtgtgcacgtctgtctgtccgtctgtgcttgtggctatgaacgtgtgcctccacccaccccacgaccngtgactactgtgcaagctggcaagnaggtangtgnaggcaagccacnaaactggnttcggctgtcantggctntntcttccctccttggngaaaaannagaaccgntnncntttgttancgtccnngggantgaattn

SEQ ID NO: 249 - DNA, 877 bp, Homo sapiens
  misc_feature (658)..(658): n is a, c, g, or t
  misc_feature (728)..(728): n is a, c, g, or t
  misc_feature (738)..(738): n is a, c, g, or t
  misc_feature (745)..(745): n is a, c, g, or t
  misc_feature (752)..(752): n is a, c, g, or t
  misc_feature (768)..(768): n is a, c, g, or t
  misc_feature (781)..(781): n is a, c, g, or t
  misc_feature (800)..(800): n is a, c, g, or t
  misc_feature (802)..(802): n is a, c, g, or t
  misc_feature (808)..(808): n is a, c, g, or t
  misc_feature (834)..(834): n is a, c, g, or t
  misc_feature (836)..(836): n is a, c, g, or t
  misc_feature (839)..(839): n is a, c, g, or t
  misc_feature (868)..(868): n is a, c, g, or t
ttattaaagaggagaaataactatgagaggatcgcataccatcaccatcacggatcctatttaggtgacactatagaatcgtcgacccacgcgtccgtccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggnagcggcggagtcggggccggcccagtggtggtgccaaacggcggcggaaaggggccccagccgcacccancagcagtcanagcccgncagaccnttctttgaagcaaagngacctgggacatncggcttcgggttcgaacanantactgngagcatgggccaaccttggaaaaggngnggnattccggggggcccaggcgctggggcggnaattggacg

SEQ ID NO: 250 - DNA, 1275 bp, Homo sapiens
  misc_feature (827)..(827): n is a, c, g, or t
  misc_feature (889)..(889): n is a, c, g, or t
  misc_feature (932)..(932): n is a, c, g, or t
  misc_feature (951)..(951): n is a, c, g, or t
  misc_feature (961)..(962): n is a, c, g, or t
  misc_feature (975)..(975): n is a, c, g, or t
  misc_feature (977)..(977): n is a, c, g, or t
  misc_feature (980)..(980): n is a, c, g, or t
  misc_feature (984)..(984): n is a, c, g, or t
  misc_feature (988)..(988): n is a, c, g, or t
  misc_feature (1016)..(1018): n is a, c, g, or t
  misc_feature (1032)..(1032): n is a, c, g, or t
  misc_feature (1036)..(1036): n is a, c, g, or t
  misc_feature (1044)..(1044): n is a, c, g, or t
  misc_feature (1069)..(1070): n is a, c, g, or t
  misc_feature (1083)..(1083): n is a, c, g, or t
  misc_feature (1098)..(1098): n is a, c, g, or t
  misc_feature (1103)..(1103): n is a, c, g, or t
  misc_feature (1124)..(1124): n is a, c, g, or t
  misc_feature (1126)..(1126): n is a, c, g, or t
  misc_feature (1130)..(1132): n is a, c, g, or t
  misc_feature (1170)..(1170): n is a, c, g, or t
  misc_feature (1185)..(1185): n is a, c, g, or t
  misc_feature (1188)..(1188): n is a, c, g, or t
  misc_feature (1192)..(1192): n is a, c, g, or t
  misc_feature (1209)..(1209): n is a, c, g, or t
  misc_feature (1218)..(1218): n is a, c, g, or t
  misc_feature (1239)..(1239): n is a, c, g, or t
  misc_feature (1247)..(1247): n is a, c, g, or t
  misc_feature (1249)..(1249): n is a, c, g, or t
  misc_feature (1254)..(1254): n is a, c, g, or t
  misc_feature (1258)..(1258): n is a, c, g, or t
  misc_feature (1274)..(1275): n is a, c, g, or t
tagagaaaattactatgagaggatcgcatcaccatcaccatcacggatcctatttaggtgacactatagaatcgtcgacccacgcgtccggccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagacnaacaagccgtacctggtgaactgcgtccgcatccctgcccctccagtcctcctgctttttanccggtctttgaaaccaatggtgactgctcccgcctggtggccnatggctggctgaactgcanctacaaaaanngaaagtgccatcnantcntggngggnttcctgcggttcgtgcccgctggaaaannnccttgaaccggaantggncaacaagncccaacaccattggaagaaaaagannaaaaaaaccccantcaccccaaagaagnggccncccttgaaaaaggaaattctngnattnnnggattccaaaatttttaagcctccgggggttcaaaggnttaaaatccaaaaanttntttnggaacccaaaaatccanccccccccntttttttgggttttttggaanttcccctntnccccncccnaaaagggggtaaaaann

SEQ ID NO: 251 - DNA, 1214 bp, Homo sapiens
  misc_feature (902)..(902): n is a, c, g, or t
  misc_feature (928)..(928): n is a, c, g, or t
  misc_feature (950)..(950): n is a, c, g, or t
  misc_feature (965)..(965): n is a, c, g, or t
  misc_feature (982)..(982): n is a, c, g, or t
  misc_feature (989)..(989): n is a, c, g, or t
  misc_feature (1004)..(1004): n is a, c, g, or t
  misc_feature (1018)..(1018): n is a, c, g, or t
  misc_feature (1022)..(1022): n is a, c, g, or t
  misc_feature (1048)..(1048): n is a, c, g, or t
  misc_feature (1050)..(1050): n is a, c, g, or t
  misc_feature (1059)..(1059): n is a, c, g, or t
  misc_feature (1061)..(1061): n is a, c, g, or t
  misc_feature (1066)..(1066): n is a, c, g, or t
  misc_feature (1068)..(1068): n is a, c, g, or t
  misc_feature (1071)..(1071): n is a, c, g, or t
  misc_feature (1085)..(1085): n is a, c, g, or t
  misc_feature (1087)..(1087): n is a, c, g, or t
  misc_feature (1096)..(1096): n is a, c, g, or t
  misc_feature (1101)..(1101): n is a, c, g, or t
  misc_feature (1117)..(1117): n is a, c, g, or t
  misc_feature (1119)..(1119): n is a, c, g, or t
  misc_feature (1122)..(1122): n is a, c, g, or t
  misc_feature (1130)..(1130): n is a, c, g, or t
  misc_feature (1132)..(1132): n is a, c, g, or t
  misc_feature (1137)..(1137): n is a, c, g, or t
  misc_feature (1148)..(1148): n is a, c, g, or t
  misc_feature (1155)..(1155): n is a, c, g, or t
  misc_feature (1162)..(1162): n is a, c, g, or t
  misc_feature (1181)..(1181): n is a, c, g, or t
  misc_feature (1185)..(1185): n is a, c, g, or t
  misc_feature (1199)..(1199): n is a, c, g, or t
  misc_feature (1208)..(1209): n is a, c, g, or t
  misc_feature (1212)..(1212): n is a, c, g, or t
  misc_feature (1214)..(1214): n is a, c, g, or t
attagagagattactatgagaggatcgcatcaccatcaccatcacggatcctatttaggtgacactatagaatcgtcgacccacgcgtccgagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgctgagaaggcagagacagatgtggaaaaaatctatcncccagtcatgtgcactgaatgttccnctgaagtggcagtctacgacanggatgaagtctttcntttttcccatgttttancaagccnttcctaaacagcccnactggcatttattncccnatactgtatataaggcaaattggacngntactttccncntgccngntcnaatccttcagggantngaggaaccntgttncctttttaaggaaaanantgncaccttcntnctccnttaatcccccnccccccnttttttncttgatttcccccctatgngggnacgaaatccttcgntttgaaaannttngn

SEQ ID NO: 252 - DNA, 1090 bp, Homo sapiens
  misc_feature (1)..(1): n is a, c, g, or t
  misc_feature (753)..(753): n is a, c, g, or t
  misc_feature (795)..(795): n is a, c, g, or t
  misc_feature (815)..(815): n is a, c, g, or t
  misc_feature (818)..(818): n is a, c, g, or t
  misc_feature (844)..(844): n is a, c, g, or t
  misc_feature (851)..(851): n is a, c, g, or t
  misc_feature (868)..(868): n is a, c, g, or t
  misc_feature (876)..(876): n is a, c, g, or t
  misc_feature (882)..(882): n is a, c, g, or t
  misc_feature (915)..(915): n is a, c, g, or t
  misc_feature (918)..(918): n is a, c, g, or t
  misc_feature (920)..(920): n is a, c, g, or t
  misc_feature (922)..(922): n is a, c, g, or t
  misc_feature (941)..(941): n is a, c, g, or t
  misc_feature (948)..(948): n is a, c, g, or t
  misc_feature (951)..(951): n is a, c, g, or t
  misc_feature (955)..(955): n is a, c, g, or t
  misc_feature (964)..(964): n is a, c, g, or t
  misc_feature (967)..(967): n is a, c, g, or t
  misc_feature (979)..(979): n is a, c, g, or t
  misc_feature (984)..(985): n is a, c, g, or t
  misc_feature (993)..(993): n is a, c, g, or t
  misc_feature (995)..(995): n is a, c, g, or t
  misc_feature (997)..(997): n is a, c, g, or t
  misc_feature (1004)..(1004): n is a, c, g, or t
  misc_feature (1006)..(1006): n is a, c, g, or t
  misc_feature (1009)..(1009): n is a, c, g, or t
  misc_feature (1012)..(1012): n is a, c, g, or t
  misc_feature (1015)..(1015): n is a, c, g, or t
  misc_feature (1020)..(1020): n is a, c, g, or t
  misc_feature (1028)..(1028): n is a, c, g, or t
  misc_feature (1032)..(1032): n is a, c, g, or t
  misc_feature (1045)..(1045): n is a, c, g, or t
  misc_feature (1050)..(1050): n is a, c, g, or t
  misc_feature (1052)..(1052): n is a, c, g, or t
  misc_feature (1057)..(1057): n is a, c, g, or t
  misc_feature (1069)..(1069): n is a, c, g, or t
  misc_feature (1071)..(1071): n is a, c, g, or t
  misc_feature (1076)..(1076): n is a, c, g, or t
  misc_feature (1080)..(1080): n is a, c, g, or t
  misc_feature (1089)..(1089): n is a, c, g, or t
nagagaaattactatgagaggatcgcatcaccatcaccatcacggatcctatttaggtgacactatagaatcgtcgacccacgcgtccggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctgganacgtcctcagagccgtggagcaagccatgggccacagccagnaccggctcaccaccttccanganaaccaagcccgcactcacgtcctcancaaggangtccagcacctccgggnaggaaaantccaancagttcctcgacttgatggaaactattgataancancnanaaaaaatggccaaaaacancagggcntcngcancccgtgtanggnaacttcaggaanccctnnaatgaaangnantccatcntnaangcnttnaaggncaaactgnaaantaaaaaaaagccnccctngnttttntcgaaacaaaangnccaanaacntgggggaant

SEQ ID NO: 253 - DNA, 548 bp, Homo sapiens
tgagaggtcgcatcaccatcaccatcacggatcctatttaggtgacactatagaatcgtcgacccacgcgtccgcccacgcgtccgctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 254 - DNA, 1163 bp, Homo sapiens
  misc_feature (5)..(5): n is a, c, g, or t
  misc_feature (829)..(829): n is a, c, g, or t
  misc_feature (845)..(845): n is a, c, g, or t
  misc_feature (905)..(905): n is a, c, g, or t
  misc_feature (943)..(943): n is a, c, g, or t
  misc_feature (969)..(969): n is a, c, g, or t
  misc_feature (971)..(971): n is a, c, g, or t
  misc_feature (974)..(974): n is a, c, g, or t
  misc_feature (994)..(994): n is a, c, g, or t
  misc_feature (996)..(996): n is a, c, g, or t
  misc_feature (1008)..(1009): n is a, c, g, or t
  misc_feature (1017)..(1017): n is a, c, g, or t
  misc_feature (1022)..(1022): n is a, c, g, or t
  misc_feature (1026)..(1027): n is a, c, g, or t
  misc_feature (1031)..(1031): n is a, c, g, or t
  misc_feature (1043)..(1043): n is a, c, g, or t
  misc_feature (1049)..(1050): n is a, c, g, or t
  misc_feature (1070)..(1070): n is a, c, g, or t
  misc_feature (1073)..(1073): n is a, c, g, or t
  misc_feature (1076)..(1076): n is a, c, g, or t
  misc_feature (1081)..(1081): n is a, c, g, or t
  misc_feature (1085)..(1085): n is a, c, g, or t
  misc_feature (1098)..(1098): n is a, c, g, or t
  misc_feature (1107)..(1107): n is a, c, g, or t
  misc_feature (1122)..(1122): n is a, c, g, or t
  misc_feature (1127)..(1127): n is a, c, g, or t
  misc_feature (1129)..(1129): n is a, c, g, or t
  misc_feature (1132)..(1132): n is a, c, g, or t
  misc_feature (1134)..(1137): n is a, c, g, or t
  misc_feature (1147)..(1147): n is a, c, g, or t
  misc_feature (1160)..(1160): n is a, c, g, or t
agagnaattactatgagaggatcgcatcaccatcaccatcacggatcctatttaggtgacactatagaatcgtcgacccacgcgtccgcgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccnaaaagaagaagaaagntgtggttcctggagggggattaaaagccaccatgaaagatgatctggcaaattatggtgnttatgatggaggatttgtacaagactatgaagacttcntgtgacattttatcttttcttggggncntcntttatgttgcccccaatccntngaacttgtagcnnaactttcnttttntttnngttntgccaaatgctncaatcnnaagtgcagtatctttttggntgnttntttancccnttgaactttaggngcctattgnccaattgaaggaacnttggntnttntnnnnccaggggttnaaattgggaaacntaa

SEQ ID NO: 255 - DNA, 920 bp, Homo sapiens
  misc_feature (739)..(739): n is a, c, g, or t
  misc_feature (759)..(759): n is a, c, g, or t
  misc_feature (765)..(765): n is a, c, g, or t
  misc_feature (767)..(767): n is a, c, g, or t
  misc_feature (773)..(773): n is a, c, g, or t
  misc_feature (782)..(783): n is a, c, g, or t
  misc_feature (795)..(795): n is a, c, g, or t
  misc_feature (802)..(803): n is a, c, g, or t
  misc_feature (818)..(818): n is a, c, g, or t
  misc_feature (836)..(836): n is a, c, g, or t
  misc_feature (868)..(868): n is a, c, g, or t
  misc_feature (873)..(874): n is a, c, g, or t
  misc_feature (876)..(876): n is a, c, g, or t
  misc_feature (885)..(885): n is a, c, g, or t
  misc_feature (887)..(887): n is a, c, g, or t
  misc_feature (889)..(891): n is a, c, g, or t
  misc_feature (897)..(898): n is a, c, g, or t
  misc_feature (901)..(901): n is a, c, g, or t
  misc_feature (910)..(910): n is a, c, g, or t
  misc_feature (914)..(914): n is a, c, g, or t
caatagagagaattactatgagaggatcgcatcaccatcaccatcacggatcctatttaggtgacactatagaatcgtcgacccacgcgtccggccgccgccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccantggggctaccccactccccnaccccnantgccanccggaggannccaggggtccanccacgannagagctccatgtcangactggccgctgccatanctggggccaactgaaaaaattcaaacggccanaaaanncntctggaagntncnnntcccannggnacttcaaantccnatgcca

SEQ ID NO: 256 - DNA, 1129 bp, Homo sapiens
  misc_feature (1)..(1): n is a, c, g, or t
  misc_feature (700)..(700): n is a, c, g, or t
  misc_feature (785)..(785): n is a, c, g, or t
  misc_feature (802)..(802): n is a, c, g, or t
  misc_feature (811)..(811): n is a, c, g, or t
  misc_feature (815)..(815): n is a, c, g, or t
  misc_feature (823)..(824): n is a, c, g, or t
  misc_feature (846)..(846): n is a, c, g, or t
  misc_feature (854)..(854): n is a, c, g, or t
  misc_feature (877)..(877): n is a, c, g, or t
  misc_feature (887)..(887): n is a, c, g, or t
  misc_feature (891)..(891): n is a, c, g, or t
  misc_feature (901)..(901): n is a, c, g, or t
  misc_feature (908)..(908): n is a, c, g, or t
  misc_feature (919)..(919): n is a, c, g, or t
  misc_feature (922)..(922): n is a, c, g, or t
  misc_feature (944)..(944): n is a, c, g, or t
  misc_feature (956)..(956): n is a, c, g, or t
  misc_feature (958)..(958): n is a, c, g, or t
  misc_feature (961)..(961): n is a, c, g, or t
  misc_feature (970)..(970): n is a, c, g, or t
  misc_feature (978)..(978): n is a, c, g, or t
  misc_feature (980)..(980): n is a, c, g, or t
  misc_feature (988)..(988): n is a, c, g, or t
  misc_feature (999)..(999): n is a, c, g, or t
  misc_feature (1005)..(1005): n is a, c, g, or t
  misc_feature (1011)..(1011): n is a, c, g, or t
  misc_feature (1016)..(1017): n is a, c, g, or t
  misc_feature (1026)..(1027): n is a, c, g, or t
  misc_feature (1036)..(1036): n is a, c, g, or t
  misc_feature (1039)..(1042): n is a, c, g, or t
  misc_feature (1055)..(1055): n is a, c, g, or t
  misc_feature (1067)..(1067): n is a, c, g, or t
  misc_feature (1076)..(1076): n is a, c, g, or t
  misc_feature (1082)..(1082): n is a, c, g, or t
  misc_feature (1094)..(1094): n is a, c, g, or t
  misc_feature (1096)..(1096): n is a, c, g, or t
  misc_feature (1101)..(1101): n is a, c, g, or t
  misc_feature (1106)..(1106): n is a, c, g, or t
  misc_feature (1125)..(1126): n is a, c, g, or t
  misc_feature (1128)..(1128): n is a, c, g, or t
ntagagaaattactatgagaggatcgcatcaccatcaccatcacggatcctatttaggtgacactatagaatcgtcgacccacgcgtccggggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcangtctggggaagtatgacctggacttcaagtctcccgatgaccccagccaggtacatctccccctgaccagctggctgaactgtanaagtccttcatcaaagnactacccantggngtcctatnnaaaaatccctttgaccaagatnactggggnaactttggcaaaaaatttcccanccaggggcangaantccaggtaantgggggnatgatctcccnagngaacccaaccccaaaaaaggancccccaaggccngnaancaaaaaatncttggaantnccccctgntccaaattcanccaaanttggcnccccnngacccaaanncccttcaanggnnnnaaacttggcccanaaccaaaggttngggcccccnggggtntccccccccttncnggggnaaaanaaaaaaaacctcctccccnnanc

SEQ ID NO: 257 - DNA, 1002 bp, Homo sapiens
  misc_feature (6)..(6): n is a, c, g, or t
  misc_feature (884)..(884): n is a, c, g, or t
  misc_feature (889)..(889): n is a, c, g, or t
  misc_feature (925)..(925): n is a, c, g, or t
  misc_feature (939)..(939): n is a, c, g, or t
  misc_feature (958)..(958): n is a, c, g, or t
  misc_feature (966)..(966): n is a, c, g, or t
  misc_feature (968)..(969): n is a, c, g, or t
  misc_feature (1001)..(1001): n is a, c, g, or t
tagagngaattactatgagaggatcgcatcaccatcaccatcacggatcctatttaggtgacactatagaatcgtcgacccacgcgtccgcattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccggggaacagtcggaagaaagaaagcttcttgctatctacctccaccatgatgnaaagngtgttaaccaacgggttctgctcacaaatgctttgngctgaatccattgnttcttatctgagtcaaaantttataancnngggcttggggatctgacaaaggactcccacana

SEQ ID NO: 258 - DNA, 1023 bp, Homo sapiens; identical to SEQ ID NO: 192
  misc_feature (1)..(1): n is a, c, g, or t
  misc_feature (836)..(836): n is a, c, g, or t
  misc_feature (838)..(838): n is a, c, g, or t
  misc_feature (843)..(843): n is a, c, g, or t
  misc_feature (864)..(864): n is a, c, g, or t
  misc_feature (871)..(871): n is a, c, g, or t
  misc_feature (874)..(874): n is a, c, g, or t
  misc_feature (878)..(878): n is a, c, g, or t
  misc_feature (880)..(880): n is a, c, g, or t
  misc_feature (921)..(921): n is a, c, g, or t
  misc_feature (930)..(930): n is a, c, g, or t
  misc_feature (943)..(943): n is a, c, g, or t
  misc_feature (966)..(966): n is a, c, g, or t
  misc_feature (973)..(974): n is a, c, g, or t
  misc_feature (977)..(977): n is a, c, g, or t
  misc_feature (981)..(981): n is a, c, g, or t
  misc_feature (997)..(997): n is a, c, g, or t
  misc_feature (1002)..(1002): n is a, c, g, or t
  misc_feature (1008)..(1008): n is a, c, g, or t
  misc_feature (1012)..(1013): n is a, c, g, or t
  misc_feature (1016)..(1018): n is a, c, g, or t
  misc_feature (1021)..(1021): n is a, c, g, or t

SEQ ID NO: 259 - DNA, 1184 bp, Homo sapiens
  misc_feature (879)..(879): n is a, c, g, or t
  misc_feature (882)..(882): n is a, c, g, or t
  misc_feature (896)..(896): n is a, c, g, or t
  misc_feature (957)..(957): n is a, c, g, or t
  misc_feature (974)..(974): n is a, c, g, or t
  misc_feature (1018)..(1018): n is a, c, g, or t
  misc_feature (1034)..(1034): n is a, c, g, or t
  misc_feature (1040)..(1040): n is a, c, g, or t
  misc_feature (1062)..(1062): n is a, c, g, or t
  misc_feature (1088)..(1088): n is a, c, g, or t
  misc_feature (1096)..(1096): n is a, c, g, or t
  misc_feature (1104)..(1104): n is a, c, g, or t
  misc_feature (1106)..(1106): n is a, c, g, or t
  misc_feature (1126)..(1127): n is a, c, g, or t
  misc_feature (1130)..(1130): n is a, c, g, or t
  misc_feature (1132)..(1134): n is a, c, g, or t
  misc_feature (1166)..(1166): n is a, c, g, or t
  misc_feature (1169)..(1169): n is a, c, g, or t
  misc_feature (1174)..(1174): n is a, c, g, or t
  misc_feature (1177)..(1177): n is a, c, g, or t
  misc_feature (1179)..(1179): n is a, c, g, or t
  misc_feature (1181)..(1181): n is a, c, g, or t
gagaaattactatgagaggatcgcatcaccatcaccatcacggatcctatttaggtgacactatagaatcgtcgacccacgcgtccgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaatgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttaaagttggtggagtctganganagatatttttctcntttgttgccaacatcctgtttaccaaaagtgtcaccccaccatcttccataagctgtgaancaaaatcaatgaggtcnctaacttaaaagggaaaaaaagttttctgggtctttgttttctngatttgggggtaattnatacanggcatacaagttgattttaaangtggaactggggaggtaaactaattngaaaaaanctttgaangntccttgggaatccccatttnnggncnnnaaaaggggaaggacattttttaaaaatataanagngggcnccntncnccc

SEQ ID NO: 260 - DNA, 974 bp, Homo sapiens
  misc_feature (8)..(8): n is a, c, g, or t
  misc_feature (858)..(858): n is a, c, g, or t
  misc_feature (870)..(870): n is a, c, g, or t
  misc_feature (915)..(915): n is a, c, g, or t
  misc_feature (930)..(930): n is a, c, g, or t
  misc_feature (958)..(958): n is a, c, g, or t
attagagnaattactatgagaggatcgcatcaccatcaccatcacggatcctatttaggtgacactatagaatcgtcgacccacgcgtccgcaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctggtttccattgcctgccttanaaactggctggnaagaagacaatgtggacctgacttaggcattttgtaattggaaangtcaagactggcagntatgtgcacatgcgcacgcgcatgcacncacacacacacccagt

SEQ ID NO: 261 - DNA, 1179 bp, Homo sapiens
  misc_feature (895)..(895): n is a, c, g, or t
  misc_feature (918)..(918): n is a, c, g, or t
  misc_feature (946)..(946): n is a, c, g, or t
  misc_feature (977)..(977): n is a, c, g, or t
  misc_feature (990)..(990): n is a, c, g, or t
  misc_feature (1010)..(1010): n is a, c, g, or t
  misc_feature (1012)..(1012): n is a, c, g, or t
  misc_feature (1015)..(1015): n is a, c, g, or t
  misc_feature (1027)..(1027): n is a, c, g, or t
  misc_feature (1035)..(1036): n is a, c, g, or t
  misc_feature (1049)..(1050): n is a, c, g, or t
  misc_feature (1054)..(1054): n is a, c, g, or t
  misc_feature (1059)..(1059): n is a, c, g, or t
  misc_feature (1063)..(1063): n is a, c, g, or t
  misc_feature (1071)..(1071): n is a, c, g, or t
  misc_feature (1074)..(1074): n is a, c, g, or t
  misc_feature (1085)..(1085): n is a, c, g, or t
  misc_feature (1088)..(1088): n is a, c, g, or t
  misc_feature (1098)..(1098): n is a, c, g, or t
  misc_feature (1108)..(1108): n is a, c, g, or t
  misc_feature (1114)..(1115): n is a, c, g, or t
  misc_feature (1127)..(1127): n is a, c, g, or t
  misc_feature (1130)..(1130): n is a, c, g, or t
  misc_feature (1137)..(1137): n is a, c, g, or t
  misc_feature (1140)..(1141): n is a, c, g, or t
  misc_feature (1149)..(1149): n is a, c, g, or t
  misc_feature (1154)..(1154): n is a, c, g, or t
  misc_feature (1173)..(1173): n is a, c, g, or t
tagagaaattactatgagaggatcgcatcaccatcaccatcacggaatcctatttaggtgacactatagaatcgtcgacccacgcgtccggtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagcccccgcaggacccagcgtgggcgcccttccagcttcctctagctttgggncctatgctgtcccctgcaggccntagggaaacccccttgcaactatgcggnctttcaaacttcctcctcagccacctggccnctgaaaacagccntagcctgggttaacggaaananccnccttaaggcaanaatggaannggaaccccccttnnctcnttttntgancccgtttnccnaaaaccccccnttncaggtgcttnttaagggggnttgccnntaacaaaacctnctnaatggcntcnnaacatttnttttnaaatggaaaccaaaaaaancctggc

SEQ ID NO: 262 - DNA, 1070 bp, Homo sapiens
  misc_feature (756)..(756): n is a, c, g, or t
  misc_feature (790)..(790): n is a, c, g, or t
  misc_feature (839)..(839): n is a, c, g, or t
  misc_feature (867)..(867): n is a, c, g, or t
  misc_feature (927)..(927): n is a, c, g, or t
  misc_feature (933)..(933): n is a, c, g, or t
  misc_feature (939)..(939): n is a, c, g, or t
  misc_feature (964)..(964): n is a, c, g, or t
  misc_feature (966)..(966): n is a, c, g, or t
  misc_feature (969)..(969): n is a, c, g, or t
  misc_feature (974)..(974): n is a, c, g, or t
  misc_feature (977)..(977): n is a, c, g, or t
  misc_feature (999)..(999): n is a, c, g, or t
  misc_feature (1002)..(1002): n is a, c, g, or t
  misc_feature (1004)..(1004): n is a, c, g, or t
  misc_feature (1006)..(1006): n is a, c, g, or t
  misc_feature (1010)..(1010): n is a, c, g, or t
  misc_feature (1014)..(1014): n is a, c, g, or t
  misc_feature (1019)..(1019): n is a, c, g, or t
  misc_feature (1031)..(1031): n is a, c, g, or t
  misc_feature (1039)..(1039): n is a, c, g, or t
  misc_feature (1045)..(1045): n is a, c, g, or t
  misc_feature (1051)..(1051): n is a, c, g, or t
  misc_feature (1054)..(1054): n is a, c, g, or t
  misc_feature (1056)..(1056): n is a, c, g, or t
  misc_feature (1058)..(1058): n is a, c, g, or t
  misc_feature (1060)..(1060): n is a, c, g, or t
  misc_feature (1062)..(1062): n is a, c, g, or t
ggaatagagagaattactatgagaggatcgcatcaccatcaccatcacggatcctatttaggtgacactatagaatcgtcgacccacgcgtccgctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcanagtacgtcatgccctgccttaccccccagggctnccaaaactagtggaagagaaggtcgcctccgaaacatctcctttgcctntgaaaattgatggtgctgaaggaaagancccaagtctggggtcaccaaaatctctcggagggaccagtatttttggttaaaaaggggnatggcnggaaantcttctctggcctcctaaccttttntnatntccgnctncaatctccaagtgggccccaanatncntntggngaanggttnccccatggaagnccacctgntgaacntaatcnggnantntntnaggaggga

SEQ ID NO: 263 - DNA, 720 bp, Homo sapiens
  misc_feature (1)..(1): n is a, c, g, or t
  misc_feature (3)..(3): n is a, c, g, or t
  misc_feature (529)..(530): n is a, c, g, or t
  misc_feature (532)..(532): n is a, c, g, or t
  misc_feature (544)..(544): n is a, c, g, or t
  misc_feature (584)..(584): n is a, c, g, or t
  misc_feature (594)..(594): n is a, c, g, or t
  misc_feature (602)..(602): n is a, c, g, or t
  misc_feature (626)..(627): n is a, c, g, or t
  misc_feature (629)..(629): n is a, c, g, or t
  misc_feature (645)..(645): n is a, c, g, or t
  misc_feature (653)..(653): n is a, c, g, or t
  misc_feature (658)..(659): n is a, c, g, or t
  misc_feature (663)..(664): n is a, c, g, or t
  misc_feature (678)..(679): n is a, c, g, or t
  misc_feature (682)..(682): n is a, c, g, or t
  misc_feature (684)..(684): n is a, c, g, or t
  misc_feature (699)..(699): n is a, c, g, or t
  misc_feature (703)..(704): n is a, c, g, or t
  misc_feature (709)..(709): n is a, c, g, or t
  misc_feature (712)..(712): n is a, c, g, or t
  misc_feature (715)..(716): n is a, c, g, or t
nantagagaaattaactatggagaggatcgcatcaccatcaccatcacggatcctatttaggtgacactatagaatcgtcgacccacgcgtccgcctgtggctacctctggccctgcgtattccccaggcccagcctcgccaggccaggcctattcagctgctcccccctcctcctgcgccccctcctcctcctcttcttctgaatggcaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctgnnanccccctgctganctgtctgcactctccctggaggaggtctctcgcaatctgngtttcatcgngctctcanaggatgtggtgagcttctttgccnnanaacgcatcgatggtancatctttntgcanntcanngaagacaatcctgnnaanangactttccacctcancaanntgaangtnaannaaaa

SEQ ID NO: 264 - DNA, 1214 bp, Homo sapiens
  misc_feature (8)..(9): n is a, c, g, or t
  misc_feature (811)..(811): n is a, c, g, or t
cccacccnncctgagagatactagagaggatcgcatcaccatcaccatcacggtcgacccacgcgtccgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggntcaagggcagcaggaaagacgagatcctgggcatcgccaacaaccgactgatccgcatcgacttggccgcgggcgacgtggtcaaaacctggcgtttcagcaaaatgggccaatggaatgtcaactgggaaatcccacaggtggacattcaaatttaatgaaaactcccatgcgtcctcccctagcatcaccggcccctcgcccaatgtaacacaactatttcccgcgctaaatatctccttccactcccaccacacaccccccgttgattagctcaacaaactaactcttcaaaagataaccaatccccaccacatactccgacttccttcatttacaacctccacctcacatcacttctccacctcaccccctacaatatccttcaaacgtctctaccact

SEQ ID NO: 265 - DNA, 1179 bp, Homo sapiens
  misc_feature (913)..(913): n is a, c, g, or t
  misc_feature (951)..(951): n is a, c, g, or t
  misc_feature (954)..(954): n is a, c, g, or t
  misc_feature (965)..(965): n is a, c, g, or t
  misc_feature (977)..(977): n is a, c, g, or t
  misc_feature (987)..(987): n is a, c, g, or t
  misc_feature (1006)..(1006): n is a, c, g, or t
  misc_feature (1036)..(1036): n is a, c, g, or t
  misc_feature (1049)..(1049): n is a, c, g, or t
  misc_feature (1059)..(1059): n is a, c, g, or t
  misc_feature (1078)..(1078): n is a, c, g, or t
  misc_feature (1081)..(1081): n is a, c, g, or t
  misc_feature (1085)..(1085): n is a, c, g, or t
  misc_feature (1089)..(1089): n is a, c, g, or t
  misc_feature (1098)..(1098): n is a, c, g, or t
  misc_feature (1106)..(1106): n is a, c, g, or t
  misc_feature (1123)..(1123): n is a, c, g, or t
  misc_feature (1126)..(1126): n is a, c, g, or t
  misc_feature (1138)..(1138): n is a, c, g, or t
  misc_feature (1140)..(1140): n is a, c, g, or t
  misc_feature (1145)..(1146): n is a, c, g, or t
  misc_feature (1149)..(1149): n is a, c, g, or t
  misc_feature (1155)..(1155): n is a, c, g, or t
  misc_feature (1167)..(1167): n is a, c, g, or t
  misc_feature (1172)..(1172): n is a, c, g, or t
  misc_feature (1175)..(1176): n is a, c, g, or t
  misc_feature (1178)..(1178): n is a, c, g, or t
aattagagaaattactatgagaggatcgcatcaccatcaccatcacggatcctatttaggtgacactatagaatcgtcgacccacgcgtccgggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacctcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaanaggatcataaccctgtcttcaaaacactgggatttcancancaagttggaanaaggactggtangttccctccnagccagtcacctgtaaaantcctgtcctctgccaaatttttaatctctncataactcccaantgactggganccctctctacttgaatccntgntcantggncccggcaanaaactggntgagtttcctggtaaantanggaattaccctntnatccnnggntcaaanctggctaaatcnggaanganntnt

SEQ ID NO: 266 - DNA, 1166 bp, Homo sapiens
  misc_feature (932)..(932): n is a, c, g, or t
  misc_feature (941)..(941): n is a, c, g, or t
  misc_feature (954)..(954): n is a, c, g, or t
  misc_feature (956)..(956): n is a, c, g, or t
  misc_feature (978)..(978): n is a, c, g, or t
  misc_feature (984)..(984): n is a, c, g, or t
  misc_feature (986)..(986): n is a, c, g, or t
  misc_feature (988)..(988): n is a, c, g, or t
  misc_feature (995)..(995): n is a, c, g, or t
  misc_feature (1001)..(1001): n is a, c, g, or t
  misc_feature (1005)..(1005): n is a, c, g, or t
  misc_feature (1010)..(1010): n is a, c, g, or t
  misc_feature (1035)..(1035): n is a, c, g, or t
  misc_feature (1075)..(1075): n is a, c, g, or t
  misc_feature (1096)..(1096): n is a, c, g, or t
  misc_feature (1110)..(1110): n is a, c, g, or t
  misc_feature (1112)..(1112): n is a, c, g, or t
  misc_feature (1123)..(1123): n is a, c, g, or t
  misc_feature (1137)..(1137): n is a, c, g, or t
  misc_feature (1144)..(1145): n is a, c, g, or t
  misc_feature (1147)..(1147): n is a, c, g, or t
  misc_feature (1150)..(1150): n is a, c, g, or t
  misc_feature (1157)..(1157): n is a, c, g, or t
  misc_feature (1160)..(1160): n is a, c, g, or t
  misc_feature (1163)..(1163): n is a, c, g, or t
tagagaaattactatgagaggatcgcatcaccatcaccatcacggatcctatttaggtgacactatagaatcgtcgacccacgcgtccgggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgantccttgganaggcaaatgcccnancaggaagaacggcacgtgcggnaggcgncnanttatcangaagcnctgncccgnctgaagaaaaagggcaaaacctcangaacaaatggcccccccttgcaggaatacaagaactgctnatgtcagctggcctgaaatcnaaatccccctaagnanctgctaagggnaagaaaacggatcncattccnngnaancttttcnacntgnaat

SEQ ID NO: 267 - DNA, 883 bp, Homo sapiens
catcaccatcaccatcacggatcctatttaggtgacactatagaatcgtcgacccacgcgtccgtgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaaagcaacagtacaggtggtcattctggccgaccctgacggacatgaaatttgctttgtcggggatgaagcatttcgagaactttctaagatg

SEQ ID NO: 268 - DNA, 1171 bp, Homo sapiens
  misc_feature (888)..(888): n is a, c, g, or t
  misc_feature (922)..(922): n is a, c, g, or t
  misc_feature (947)..(947): n is a, c, g, or t
  misc_feature (963)..(963): n is a, c, g, or t
  misc_feature (1019)..(1019): n is a, c, g, or t
  misc_feature (1023)..(1023): n is a, c, g, or t
  misc_feature (1042)..(1042): n is a, c, g, or t
  misc_feature (1057)..(1057): n is a, c, g, or t
  misc_feature (1059)..(1059): n is a, c, g, or t
  misc_feature (1074)..(1074): n is a, c, g, or t
  misc_feature (1088)..(1088): n is a, c, g, or t
  misc_feature (1090)..(1090): n is a, c, g, or t
  misc_feature (1093)..(1093): n is a, c, g, or t
  misc_feature (1095)..(1095): n is a, c, g, or t
  misc_feature (1101)..(1101): n is a, c, g, or t
  misc_feature (1103)..(1103): n is a, c, g, or t
  misc_feature (1105)..(1105): n is a, c, g, or t
  misc_feature (1109)..(1109): n is a, c, g, or t
  misc_feature (1120)..(1120): n is a, c, g, or t
  misc_feature (1124)..(1124): n is a, c, g, or t
  misc_feature (1132)..(1132): n is a, c, g, or t
  misc_feature (1141)..(1142): n is a, c, g, or t
  misc_feature (1145)..(1145): n is a, c, g, or t
  misc_feature (1148)..(1148): n is a, c, g, or t
  misc_feature (1152)..(1152): n is a, c, g, or t
  misc_feature (1168)..(1168): n is a, c, g, or t
  misc_feature (1171)..(1171): n is a, c, g, or t
atagagagaattactatgagaggatcgcatcaccatcaccatcacggatcctatttaggtgacactatagaatcgtcgacccacgcgtccgggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcngggagataccgagaagtaagggatgaagatgacnattggtcctctgatgaattctgaanataatctcctaaatcnctgacgttgaaatgtcatcatcttacatcaaactttctaactagtatcagatcagngtcnaaattgttgagggaagtantttataaagttaccnanggtagtttaaaaaanccccatttgtcttncnaangngacttncngngctngaaaggttaantttngaaattgngtttacccnnggnatnaaantttgcaaaaattgggnatn

SEQ ID NO: 269 - DNA, 461 bp, Homo sapiens
atgcgtggtcgtgaactgccgctggttctgctggcactggttctgtgtctggcaccgcgtggtcgtgcagttccgctgcctgctggcggtggtacagttctgaccaaaatgtatccgcgtggtaatcattgggcagttggtcatctgatgggtaaaaaaagcaccggtgaaagcagcagcgttagcgaacgtggtagcctgaaacagcagctgcgtgaatatattcgttgggaagaagcagcacgtaatctgctgggtctgattgaagcaaaagaaaatcgcaatcatcagcctccgcagccgaaagcactgggtaatcagcagccgagctgggatagcgaagatagcagcaactttaaagatgtgggcagcaaaggtaaagttggtcgtctgagcgcaccgggtagccagcgtgaaggtcgtaatccgcagctgaatcagcagtaagcggccgcgagctc

SEQ ID NO: 270 - DNA, 802 bp, Homo sapiens
ctatgagaggtcgcatcaccatcaccatcacggatcctatttaggtgacactatagaatcgtcgacccacgcgtccgggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagag

SEQ ID NO: 271 - DNA, 897 bp, Homo sapiens
  misc_feature (794)..(794): n is a, c, g, or t
  misc_feature (798)..(799): n is a, c, g, or t
  misc_feature (817)..(817): n is a, c, g, or t
  misc_feature (826)..(826): n is a, c, g, or t
  misc_feature (849)..(849): n is a, c, g, or t
atagagagatactatgagaggtcgcatcaccatcaccatcacggatcctatttaggtgacactatagaatcgtcgactctggaccttggctgtcactcagttaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacgctaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacagcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagaatttttcttcagcagccaggcagaagtcccgcctctctctctcgttcaggnaggnnactgtcatgactcatggntacattcangatacttgagcactttaatactnacgtacactgtagctatttttatgtgataatctgttgataaaaagtaa

SEQ ID NO: 272 - DNA, 1334 bp, Homo sapiens
  misc_feature (1)..(1): n is a, c, g, or t
  misc_feature (11)..(11): n is a, c, g, or t
  misc_feature (876)..(876): n is a, c, g, or t
ncccgtgcctnctaagagatactagagaggatcgcatcaccatcaccatcacggtcgacccacgcgtccggccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggttctaaagtcccatgccaaacccgccagaacagcgcgaccacaccaccatgactgggatgggcaacgggggnccccgggttcgccggcccaattcctggggccaacatggaaccgaaccccgggggccccacccctgttttgggcaatttgcccccctgacaaacaaaaccaggtggaacaccccaaactttaggactttcctgggggcgccccaacactggggcaacacccctccaaaaccttttcaccggagggtttccgacaccaccctaactcttcacccacaacctaaacatcattacaccaacctaactctatctaactcaacccccaaatttctcacctactccctccaatcaaaaatctatccacatcacaacatataacacaccaccctccacaccacacctccaacccacacattcacttaacctacccaatacatccacaaaactcatcccccatcacaacctactctttaaccacacaccataaaatcattattaccatcaacctcttttccacttac

SEQ ID NO: 273 - DNA, 872 bp, Homo sapiens
  misc_feature (722)..(722): n is a, c, g, or t
  misc_feature (737)..(737): n is a, c, g, or t
  misc_feature (744)..(744): n is a, c, g, or t
  misc_feature (774)..(774): n is a, c, g, or t
  misc_feature (781)..(781): n is a, c, g, or t
  misc_feature (808)..(809): n is a, c, g, or t
  misc_feature (840)..(840): n is a, c, g, or t
atagagaattactatgagaggtcgcatcccatcaccatcacggatcctatttaggtgacactatagaatcgtcgactctggaccttggctgtcactcagtttttcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggcggnaaagaaaagtgtgangctgccnaggaagctctggaggcattggttcctgtcnacattgnagtagaggtgccctttgaccttcacgnntacgtatgggcagaaggaagtggatcgcagnatgatgatgagtttgagtgacatactgtccgg

SEQ ID NO: 274 - DNA, 1177 bp, Homo sapiens
  misc_feature (808)..(808): n is a, c, g, or t
  misc_feature (827)..(827): n is a, c, g, or t
  misc_feature (852)..(852): n is a, c, g, or t
  misc_feature (869)..(869): n is a, c, g, or t
  misc_feature (884)..(884): n is a, c, g, or t
  misc_feature (891)..(891): n is a, c, g, or t
  misc_feature (897)..(897): n is a, c, g, or t
  misc_feature (901)..(901): n is a, c, g, or t
  misc_feature (921)..(921): n is a, c, g, or t
  misc_feature (923)..(923): n is a, c, g, or t
  misc_feature (929)..(930): n is a, c, g, or t
  misc_feature (955)..(955): n is a, c, g, or t
  misc_feature (964)..(964): n is a, c, g, or t
  misc_feature (975)..(975): n is a, c, g, or t
  misc_feature (988)..(988): n is a, c, g, or t
  misc_feature (994)..(994): n is a, c, g, or t
  misc_feature (1000)..(1001): n is a, c, g, or t
  misc_feature (1003)..(1003): n is a, c, g, or t
  misc_feature (1016)..(1016): n is a, c, g, or t
  misc_feature (1026)..(1026): n is a, c, g, or t
  misc_feature (1028)..(1028): n is a, c, g, or t
  misc_feature (1032)..(1032): n is a, c, g, or t
  misc_feature (1034)..(1034): n is a, c, g, or t
  misc_feature (1040)..(1040): n is a, c, g, or t
  misc_feature (1049)..(1049): n is a, c, g, or t
  misc_feature (1072)..(1072): n is a, c, g, or t
  misc_feature (1110)..(1110): n is a, c, g, or t
  misc_feature (1115)..(1115): n is a, c, g, or t
  misc_feature (1119)..(1119): n is a, c, g, or t
  misc_feature (1131)..(1131): n is a, c, g, or t
  misc_feature (1164)..(1164): n is a, c, g, or t
  misc_feature (1167)..(1168): n is a, c, g, or t
  misc_feature (1170)..(1171): n is a, c, g, or t
  misc_feature (1173)..(1176): n is a, c, g, or t
tagagaaattactatgagaggatcgcatcaccatcaccatcacggatcctatttaggtgacactatagaatcgtcgacccacgcgtccggcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccancagagcacttatggcaagncatctcgagggggtggcaatcaccnaaaacaattaccagccntactaaaggaaaacnttggaanaaaacngggnggagatgttaaagtaacccntncttgcnngacgaccttgaaaaattggccctcnggtgaatcnaagaggaatanttttgtaaaaaanctttcntagggnncnaaaccccctttgnggcccactgntnaaancngcccantaagtttcnttggttttaccttggcccttgcnaacccggggtaagacccaaggggaattggttaaacccnttttnttgnaccattcccggnaaacccccaaaaaagccttcccttttgggaaanaannannannnna

SEQ ID NO: 275 - DNA, 1337 bp, Human
  misc_feature (1)..(2): n is a, c, g, or t
  misc_feature (12)..(12): n is a, c, g, or t
  misc_feature (15)..(15): n is a, c, g, or t
  misc_feature (922)..(922): n is a, c, g, or t
nncccactcccnccncctaggatactagagaggatgcatcaccatcaccatcacggtcgacccacgcgtccgctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagaccttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccacccctttgaaggagatgacgacacatcacgcattggaagaagtagactaatctctggctgagggatgactaancctggtcagtactctacaatcctctgatattatttttccaaggatgtttttcctttattttggtaataataaaaaggctgtatgcatgacactactttaagggaaagaaaaaattctgtcactaagggaggcggggatacttagcactaagcaaactagaaggctttttaggtcccgggggggttatttcccaaaaggggggaacggccccgtaaaccatgaaaatatggttacttttggcgggccaaagggttatcgtccacccggtccaaaaaaaaaattttttttgagagccccgccacctccttgtaaaaaaaaatctccccttcgggaacttccctattctctctcgcgggaaaaatactgcgaacccccaaaaagaacacaaccctgtgggggcccccccgcttccccc

SEQ ID NO: 276 - DNA, 1308 bp, Homo sapiens
  misc_feature (935)..(935): n is a, c, g, or t
  misc_feature (960)..(960): n is a, c, g, or t
  misc_feature (963)..(963): n is a, c, g, or t
  misc_feature (976)..(976): n is a, c, g, or t
  misc_feature (986)..(986): n is a, c, g, or t
  misc_feature (1006)..(1006): n is a, c, g, or t
  misc_feature (1018)..(1018): n is a, c, g, or t
  misc_feature (1028)..(1028): n is a, c, g, or t
  misc_feature (1035)..(1035): n is a, c, g, or t
  misc_feature (1042)..(1042): n is a, c, g, or t
  misc_feature (1053)..(1053): n is a, c, g, or t
  misc_feature (1056)..(1056): n is a, c, g, or t
  misc_feature (1062)..(1062): n is a, c, g, or t
  misc_feature (1065)..(1065): n is a, c, g, or t
  misc_feature (1092)..(1092): n is a, c, g, or t
  misc_feature (1094)..(1094): n is a, c, g, or t
  misc_feature (1104)..(1104): n is a, c, g, or t
  misc_feature (1112)..(1112): n is a, c, g, or t
  misc_feature (1122)..(1122): n is a, c, g, or t
  misc_feature (1125)..(1125): n is a, c, g, or t
  misc_feature (1128)..(1128): n is a, c, g, or t
  misc_feature (1164)..(1164): n is a, c, g, or t
  misc_feature (1167)..(1167): n is a, c, g, or t
  misc_feature (1190)..(1191): n is a, c, g, or t
  misc_feature (1213)..(1213): n is a, c, g, or t
  misc_feature (1254)..(1254): n is a, c, g, or t
  misc_feature (1265)..(1266): n is a, c, g, or t
  misc_feature (1273)..(1274): n is a, c, g, or t
atagagagattactatgagaggatcgcatcaccatcaccatcacggatcctatttaggtgacactatagaatcgtcgacccacgcgtccgcccacgcgtccgaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcanaaaaaacatttgaaattaatcccanacncccgctgatcaanacatgcttcnacgaattagggaagatgaanatgaaaaaccantttggatctngctgggntttgttngaaacaccacnctncggtcnggnatcttttcccgacctaagctatggaananaaaaaaaaangctccccncatttgaacntgnccngagccaagggggaaaaaaccccaaaaaacctgaaanccnccaaaacccccaaaacccacccnnccaaaaaaaatggggggggacnaataaaaaaaccccaggatcccccgaaaaaaaatggaattncccccccttgnncgggggnngaggaaattccttttttgggaaaagttgggcccc

SEQ ID NO: 277 - DNA, 1493 bp, Homo sapiens
  misc_feature (1)..(1): n is a, c, g, or t
  misc_feature (11)..(12): n is a, c, g, or t
  misc_feature (761)..(761): n is a, c, g, or t
  misc_feature (987)..(987): n is a, c, g, or t
nccccaccccnnctaagaatactagagaggatgcatcaccatcaccatcacggtcgacccacgcgtccgacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccgnaggcgtgatgactgccctgatcaagcgcaactccaccatccccaccaagcagaccgcaatcttccccacctactccgaaacccaccccgggtgctgatcccagtgtacgaaggcgaaaggcccttactaaaaacacaaccttgttgggccgctccagttgaccgaatccccccgccccccggggccggcccccaaaacaggggaccttcaacaccaaggccacggnatcctaaactccggccccggaaaaaaaccctcacagacgccacaaaccccctccctacttcaaggccccctctccacgaagaaatcttgtccttggctctacggcaccaaacccaatccacatctcattctctcttcaaacttccacccacaaccccatggctcctacctcccataccccacccctaatgataggcgctcctctaaacctctcgagccactaacaaaacctcccatatcttctacacacttctgtacgccaaccctctcacatttcgcaacctcacctcccactccccaccgtcccgctccccacctcccctcctcacgcccctaccccgacaatacctgccaacctgtcgtgtccccaccaccccctcccctcccaccttccccctactctaagccctcagcacctcctactacctcccacccttccactcctctccctccacatacccatcctatattcactcctccctctgacccccccacccccccatactc

SEQ ID NO: 278 - DNA, 942 bp, Homo sapiens
  misc_feature (605)..(605): n is a, c, g, or t
  misc_feature (692)..(692): n is a, c, g, or t
  misc_feature (722)..(722): n is a, c, g, or t
  misc_feature (736)..(736): n is a, c, g, or t
  misc_feature (804)..(804): n is a, c, g, or t
  misc_feature (841)..(841): n is a, c, g, or t
  misc_feature (847)..(847): n is a, c, g, or t
  misc_feature (852)..(852): n is a, c, g, or t
  misc_feature (864)..(864): n is a, c, g, or t
  misc_feature (869)..(870): n is a, c, g, or t
  misc_feature (884)..(884): n is a, c, g, or t
  misc_feature (888)..(888): n is a, c, g, or t
  misc_feature (890)..(891): n is a, c, g, or t
  misc_feature (902)..(902): n is a, c, g, or t
  misc_feature (909)..(910): n is a, c, g, or t
  misc_feature (915)..(917): n is a, c, g, or t
  misc_feature (919)..(919): n is a, c, g, or t
  misc_feature (921)..(923): n is a, c, g, or t
  misc_feature (929)..(930): n is a, c, g, or t
  misc_feature (932)..(932): n is a, c, g, or t
tagagaaattactatgagaggatcgcatcaccatcaccatcacggatcctatttaggtgacactatagaatcgtcgacccacgcgtccgctagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccctccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtgnaggcccccatgcccaagctagccacgcagtccaacgagatcaccatcccagtcaccttcgagtcgcgggcccagcttgggggcccanaagctgcaaaatccgatgagactgccgccnaagtaaagccttangcccggatgcccacccctgctgccgccactggctgtgcctccccccgccaactgtgtgttcttttganacatttatcttctgtttttctcaaataaagttcaaancaaccncccanaaaataaaaaanaaaannataataataaaaanaatnannttaatagaatntaaaaannatttnnnanannntataannanaaaggggggg

SEQ ID NO: 279 - DNA, 843 bp, Homo sapiens
  misc_feature (679)..(679): n is a, c, g, or t
  misc_feature (733)..(733): n is a, c, g, or t
  misc_feature (739)..(739): n is a, c, g, or t
  misc_feature (766)..(766): n is a, c, g, or t
  misc_feature (791)..(791): n is a, c, g, or t
  misc_feature (812)..(812): n is a, c, g, or t
  misc_feature (823)..(823): n is a, c, g, or t
  misc_feature (825)..(825): n is a, c, g, or t
  misc_feature (834)..(834): n is a, c, g, or t
  misc_feature (843)..(843): n is a, c, g, or t
tagagagattacttgagaggatgcatcaccatcaccatcacggatcctatttaggtgacactatagaatcgtcgactctggaccttggctgtcactcagttaaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcactaaaagggaaagcaccctgaacatggtggtccgcaggggtaatgaagatatcatgatcacagtgattcccgagaaattgacccatangcagaggcatgagctggacttcatgtttccctcaagactctcccgtggatgacngatgangactctgggctgctggaatagacactncagactttgactgcccatttgtttngtcagtggagactccctggcnacagaatcctncntgatagttngcaggcaan

SEQ ID NO: 280 - DNA, 956 bp, Homo sapiens
tgagaggtcgcatcaccatcaccatcacggatcctatttaggtgacactatagaatcgtcgacccacgcgtccgctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaaggcccagacaggctcaggtttccttccttcgcagcttttagaccaaaatatgaaagacttacaggcctcgctacaagaacctgctaaggctgcctcagacctgactgcctggttcagcctcttcgctgacctcgaccccactctcaatcctgatgct

SEQ ID NO: 281 - DNA, 973 bp, Homo sapiens
tgagaggatcgcatcaccatcaccatcacggatcctatttaggtgacactatagaatcgtcgacccacgcgtccgcccacgcgtccgctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgttgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccacggttttctttctacaatttccaaaggttgcagatgtttttttgtgatgaatataaaattttattgtgtattacttggtttcattaaaattggttaact

SEQ ID NO: 282 - DNA, 1091 bp, Homo sapiens
  misc_feature (58)..(58): n is a, c, g, or t
  misc_feature (834)..(834): n is a, c, g, or t
  misc_feature (860)..(860): n is a, c, g, or t
  misc_feature (885)..(885): n is a, c, g, or t
  misc_feature (887)..(887): n is a, c, g, or t
  misc_feature (902)..(902): n is a, c, g, or t
  misc_feature (910)..(910): n is a, c, g, or t
  misc_feature (943)..(943): n is a, c, g, or t
  misc_feature (954)..(954): n is a, c, g, or t
  misc_feature (961)..(961): n is a, c, g, or t
  misc_feature (967)..(967): n is a, c, g, or t
  misc_feature (975)..(975): n is a, c, g, or t
  misc_feature (982)..(982): n is a, c, g, or t
  misc_feature (984)..(984): n is a, c, g, or t
  misc_feature (988)..(988): n is a, c, g, or t
  misc_feature (999)..(999): n is a, c, g, or t
  misc_feature (1005)..(1006): n is a, c, g, or t
  misc_feature (1009)..(1009): n is a, c, g, or t
  misc_feature (1011)..(1011): n is a, c, g, or t
  misc_feature (1018)..(1018): n is a, c, g, or t
  misc_feature (1024)..(1024): n is a, c, g, or t
  misc_feature (1026)..(1026): n is a, c, g, or t
  misc_feature (1034)..(1034): n is a, c, g, or t
  misc_feature (1037)..(1037): n is a, c, g, or t
  misc_feature (1046)..(1046): n is a, c, g, or t
  misc_feature (1060)..(1061): n is a, c, g, or t
  misc_feature (1067)..(1067): n is a, c, g, or t
  misc_feature (1069)..(1070): n is a, c, g, or t
  misc_feature (1083)..(1083): n is a, c, g, or t
aatagagaaattactatgagaggatcgcatcaccatcaccatcacggatcctatttangtgacactatagaatcgtcgacccacgcgtccggccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaaccgtgaagagatgccttttggacactttcaagcatactgatgaagagtttccttaaacaagcttccagccaaaaagcctgcctggaaaagatgggtccactgnccacgtgtgttctggctgtaaacaanattctttatattgccaacctcggananaagtccgggcaatcntgtgttcnttataatgaggaaaagtcaaaaacatgcagccnttaaaccctcnacaaaanagcatnaatcccanctcattntnaaanagcggaatgangatacnnaangntggaagnaaactncngggatggnccntgttttggncctgctaaaaggtnncccccncnnttgggaagggaantaaaaccc

SEQ ID NO: 283 - DNA, 1175 bp, Homo sapiens
  misc_feature (1)..(1): n is a, c, g, or t
  misc_feature (911)..(911): n is a, c, g, or t
  misc_feature (916)..(916): n is a, c, g, or t
  misc_feature (926)..(926): n is a, c, g, or t
  misc_feature (956)..(956): n is a, c, g, or t
  misc_feature (977)..(977): n is a, c, g, or t
  misc_feature (980)..(980): n is a, c, g, or t
  misc_feature (997)..(997): n is a, c, g, or t
  misc_feature (1015)..(1015): n is a, c, g, or t
  misc_feature (1020)..(1020): n is a, c, g, or t
  misc_feature (1023)..(1023): n is a, c, g, or t
  misc_feature (1026)..(1026): n is a, c, g, or t
  misc_feature (1030)..(1030): n is a, c, g, or t
  misc_feature (1038)..(1038): n is a, c, g, or t
  misc_feature (1059)..(1059): n is a, c, g, or t
  misc_feature (1068)..(1068): n is a, c, g, or t
  misc_feature (1072)..(1072): n is a, c, g, or t
  misc_feature (1075)..(1076): n is a, c, g, or t
  misc_feature (1082)..(1082): n is a, c, g, or t
  misc_feature (1094)..(1095): n is a, c, g, or t
  misc_feature (1099)..(1099): n is a, c, g, or t
  misc_feature (1110)..(1110): n is a, c, g, or t
  misc_feature (1126)..(1127): n is a, c, g, or t
  misc_feature (1156)..(1156): n is a, c, g, or t
  misc_feature (1160)..(1160): n is a, c, g, or t
  misc_feature (1171)..(1172): n is a, c, g, or t
naattagagaaattactatgagaggatcgcatcaccatcaccatcacggatcctatttaggtgacactatagaatcgtcgacccacgcgtccgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataaattctaaaatttgtggctataattaaaaagntttgnaagttaaccnggttctagttccatcattctgtgtaccagngaagtattgcatgataatggnaanttttggggaaaaactanattaaaaaaaataaccgncttgntanggnttanaattaaanaaggggcaaacaattccggcntctttaaangccngcnnaaaacngggaattttttnnttanggattggccgnaacttttaaaaaaaanntggtgaagaaaaggggattttgggggggncctnaattgcttttnnttt

SEQ ID NO: 284 - DNA, 1466 bp, Homo sapiens
atgagcattcgtgttacccagaaaagctataaagttagcaccagcggtccgcgtgcatttagcagccgtagctatacctctggtccgggtagccgtattagcagcagcagctttagccgtgttggtagcagcaattttcgtggtggtctgggtggtggttatggtggtgcaagcggtatgggtggtattaccgcagttaccgttaatcagagcctgctgtctccgctggttctggaagttgatccgaatattcaggcagttcgtacccaggaaaaagaacaaatcaaaaccctgaataataaatttgccagctttattgataaagtgcgctttctggaacagcagaacaaaatgctggaaaccaaatggtcattactgcagcagcaaaaaaccgcacgtagcaatatggataatatgtttgaaagctatattaacaatctgcgtcgtcagctggaaaccctgggtcaggaaaaactgaaactggaagccgaactgggtaatatgcagggtctggtggaagattttaaaaacaagtacgaagatgaaattaataaacgcaccgaaatggaaaatgaatttgtgctgattaaaaaagatgtggatgaagcctatatgaacaaagtggaactggaaagccgtctggaaggtctgaccgatgaaattaactttctgcgccagctgtatgaagaagaaattcgcgaactgcagagccagattagcgataccagcgttgttctgagcatggataatagccgtagcctggatatggatagcattatcgccgaagttaaagcccagtatgaagatattgcaaatcgtagccgtgcagaggcagaaagcatgtatcagatcaaatatgaagaactgcagtctctggcaggtaaacatggtgatgatctgcgtcgtaccaaaaccgaaatcagcgaaatgaatcgcaatattagccgtctgcaggcagaaattgaaggtctgaaaggtcagcgtgcaagcctggaagcagcaattgcagatgcagaacagcgtggtgaactggcaattaaagatgccaatgccaaactgagcgaactggaagcagccctgcagcgtgcaaaacaggatatggcacgtcagctgcgtgaatatcaagaactgatgaacgttaaactggccctggatattgaaattgccacctatcgtaaactgctggaaggtgaagaatctcgtctggaaagcggtatgcagaatatgagcattcataccaaaaccacctctggttatgccggtggtctgagcagcgcatatggtggtctgacctctccgggtctgagctatagcctgggtagcagctttggtagcggtgcaggtagcagctcttttagccgtaccagcagcagccgtgcagttgttgtgaaaaaaattgaaacccgtgatggtaaactggttagcgaaagctctgatgttctgccgaaataagcggccgcgagctc

SEQ ID NO: 285 - DNA, 912 bp, Homo sapiens
actatgagaggatcgcatcaccatcaccatcacggatcctatttaggtgacactatagaatcgtcgacccacgcgtccggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggag

SEQ ID NO: 286 - DNA, 1327 bp, Homo sapiens
  misc_feature (858)..(858): n is a, c, g, or t
  misc_feature (928)..(928): n is a, c, g, or t
  misc_feature (944)..(944): n is a, c, g, or t
  misc_feature (972)..(972): n is a, c, g, or t
  misc_feature (995)..(995): n is a, c, g, or t
  misc_feature (1009)..(1009): n is a, c, g, or t
  misc_feature (1011)..(1011): n is a, c, g, or t
  misc_feature (1014)..(1014): n is a, c, g, or t
  misc_feature (1044)..(1044): n is a, c, g, or t
  misc_feature (1065)..(1065): n is a, c, g, or t
  misc_feature (1085)..(1085): n is a, c, g, or t
  misc_feature (1090)..(1090): n is a, c, g, or t
  misc_feature (1094)..(1094): n is a, c, g, or t
  misc_feature (1119)..(1119): n is a, c, g, or t
  misc_feature (1127)..(1127): n is a, c, g, or t
  misc_feature (1129)..(1129): n is a, c, g, or t
  misc_feature (1136)..(1136): n is a, c, g, or t
  misc_feature (1142)..(1142): n is a, c, g, or t
  misc_feature (1154)..(1154): n is a, c, g, or t
  misc_feature (1156)..(1156): n is a, c, g, or t
  misc_feature (1166)..(1166): n is a, c, g, or t
  misc_feature (1168)..(1168): n is a, c, g, or t
  misc_feature (1172)..(1172): n is a, c, g, or t
  misc_feature (1177)..(1177): n is a, c, g, or t
  misc_feature (1180)..(1180): n is a, c, g, or t
  misc_feature (1185)..(1186): n is a, c, g, or t
  misc_feature (1197)..(1198): n is a, c, g, or t
  misc_feature (1207)..(1207): n is a, c, g, or t
  misc_feature (1219)..(1219): n is a, c, g, or t
  misc_feature (1228)..(1228): n is a, c, g, or t
  misc_feature (1230)..(1230): n is a, c, g, or t
  misc_feature (1242)..(1242): n is a, c, g, or t
  misc_feature (1249)..(1250): n is a, c, g, or t
  misc_feature (1257)..(1258): n is a, c, g, or t
  misc_feature (1261)..(1261): n is a, c, g, or t
  misc_feature (1267)..(1267): n is a, c, g, or t
  misc_feature (1275)..(1275): n is a, c, g, or t
  misc_feature (1284)..(1284): n is a, c, g, or t
  misc_feature (1290)..(1291): n is a, c, g, or t
  misc_feature (1314)..(1316): n is a, c, g, or t
  misc_feature (1322)..(1322): n is a, c, g, or t
aatagagaaattactatgagaggatcgcatcaccatcaccatcacggatcctatttaggtgacactatagaatcgtcgacccacgcgtccgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatctttacctgtatacagtgcagagccttctcagaagcacagaatatttttatatttccnttatgtgaaattttaagctgcaaatctgatggccttaatttcctttttgacactgaaagttttgtaaaanaaatcatgtccatacnctttgttgcaagatgtgaattattgacnctgaactaataactgtgtactgntcggaaggggtccncnaantttttgacttttttggaggggggtttttcntttttttaagtcttatgaggngggagggtaataacccctgngcgcntggngtatttgaaattgcccctctaaacnacatcctntnttttccngtaatnaaaacgggggtngngggggggaancntttncaaantgnacttnnacgaatttctnnaaaacaccnggttaatttttnaaaaaattntnaaggaattaccnccccggnncccgggnnggncccaantggtttgntttttcttntttttnnggggggggggggggggggggtcnnnaaaccngtttt

SEQ ID NO: 287 - DNA, 1046 bp, Homo sapiens
  misc_feature (809)..(809): n is a, c, g, or t
  misc_feature (885)..(885): n is a, c, g, or t
  misc_feature (931)..(931): n is a, c, g, or t
  misc_feature (934)..(934): n is a, c, g, or t
  misc_feature (945)..(945): n is a, c, g, or t
  misc_feature (956)..(956): n is a, c, g, or t
  misc_feature (963)..(963): n is a, c, g, or t
  misc_feature (980)..(980): n is a, c, g, or t
  misc_feature (993)..(993): n is a, c, g, or t
  misc_feature (1002)..(1002): n is a, c, g, or t
  misc_feature (1016)..(1016): n is a, c, g, or t
  misc_feature (1020)..(1021): n is a, c, g, or t
  misc_feature (1026)..(1027): n is a, c, g, or t
  misc_feature (1029)..(1029): n is a, c, g, or t
  misc_feature (1031)..(1032): n is a, c, g, or t
  misc_feature (1037)..(1037): n is a, c, g, or t
  misc_feature (1039)..(1039): n is a, c, g, or t
  misc_feature (1041)..(1041): n is a, c, g, or t
  misc_feature (1043)..(1043): n is a, c, g, or t
  misc_feature (1045)..(1045): n is a, c, g, or t
aaatagagaaattactatgagaggatcgcatcaccatcaccatcacggatcctatttaggtgacactatagaatcgtcgacccacgcgtccgcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcanaaccgacgcttactgtgcgagaatcggagggcgcgcacgcggatcccccgcctggcctggaccccgtgggggtcangttccctgcccggggcggggggggcacccggtgcccgcccccgtgnttntcccacggggnccctggtttcnaagtctntgtcacaagccttttcnggcggccagcgtngcaccgggnggggccttccgtgncaanntcaannananncctgncnanananc

SEQ ID NO: 288 - DNA, 1114 bp, Homo sapiens
  misc_feature (653)..(653): n is a, c, g, or t
  misc_feature (692)..(692): n is a, c, g, or t
  misc_feature (709)..(709): n is a, c, g, or t
  misc_feature (712)..(712): n is a, c, g, or t
  misc_feature (745)..(745): n is a, c, g, or t
  misc_feature (764)..(764): n is a, c, g, or t
  misc_feature (771)..(771): n is a, c, g, or t
  misc_feature (782)..(782): n is a, c, g, or t
  misc_feature (796)..(796): n is a, c, g, or t
  misc_feature (817)..(817): n is a, c, g, or t
  misc_feature (822)..(822): n is a, c, g, or t
  misc_feature (846)..(846): n is a, c, g, or t
  misc_feature (860)..(861): n is a, c, g, or t
  misc_feature (881)..(881): n is a, c, g, or t
  misc_feature (884)..(884): n is a, c, g, or t
  misc_feature (886)..(887): n is a, c, g, or t
  misc_feature (898)..(898): n is a, c, g, or t
  misc_feature (905)..(905): n is a, c, g, or t
  misc_feature (929)..(929): n is a, c, g, or t
  misc_feature (939)..(939): n is a, c, g, or t
  misc_feature (943)..(943): n is a, c, g, or t
  misc_feature (951)..(951): n is a, c, g, or t
  misc_feature (965)..(966): n is a, c, g, or t
  misc_feature (979)..(979): n is a, c, g, or t
  misc_feature (982)..(982): n is a, c, g, or t
  misc_feature (1008)..(1009): n is a, c, g, or t
  misc_feature (1022)..(1023): n is a, c, g, or t
  misc_feature (1030)..(1030): n is a, c, g, or t
  misc_feature (1041)..(1041): n is a, c, g, or t
  misc_feature (1055)..(1055): n is a, c, g, or t
  misc_feature (1057)..(1057): n is a, c, g, or t
  misc_feature (1064)..(1064): n is a, c, g, or t
  misc_feature (1074)..(1074): n is a, c, g, or t
  misc_feature (1077)..(1079): n is a, c, g, or t
  misc_feature (1082)..(1082): n is a, c, g, or t
  misc_feature (1086)..(1089): n is a, c, g, or t
  misc_feature (1092)..(1092): n is a, c, g, or t
  misc_feature (1096)..(1096): n is a, c, g, or t
  misc_feature (1098)..(1098): n is a, c, g, or t
  misc_feature (1110)..(1110): n is a, c, g, or t
tagagaaattactatgagaggatcgcatcaccatcaccatcacggatcctatttaggtgacactatagaatcgtcgacccacgcgtccgccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcnaagaatacactgatgtgtaccccgaaatcattgaacgancaggctattccttgganaangtatttgggattcaattgaaggaaattgataanaatgaccacttgtacattncttctcnccaccttaaancccactgatgcagncatactgggaaacgactaagnactcnccccaagctgggtctgctcatggngcttcttaacatcnntcttcatgaaagggaaatcngtncnntgaggctgtcnttttggnaagtgcttcccaaatttggggctncccccctggnaaanatcattcnctcttttggggaannggaaaaaacctcntcnctggatgaattttttaaacaaaaaannccctggaattatnnccaaaantccccaaaaanaatcccccctgaananaaatttntttttggggnccnnnccncttnnnnttnaaancnccaaaaaaaaantcct

SEQ ID NO: 289 - DNA, 839 bp, Homo sapiens
  misc_feature (1)..(2): n is a, c, g, or t
  misc_feature (471)..(471): n is a, c, g, or t
  misc_feature (495)..(495): n is a, c, g, or t
  misc_feature (543)..(543): n is a, c, g, or t
  misc_feature (550)..(550): n is a, c, g, or t
  misc_feature (567)..(567): n is a, c, g, or t
  misc_feature (583)..(583): n is a, c, g, or t
  misc_feature (610)..(610): n is a, c, g, or t
  misc_feature (634)..(634): n is a, c, g, or t
  misc_feature (649)..(649): n is a, c, g, or t
  misc_feature (656)..(656): n is a, c, g, or t
  misc_feature (694)..(695): n is a, c, g, or t
  misc_feature (701)..(701): n is a, c, g, or t
  misc_feature (708)..(708): n is a, c, g, or t
  misc_feature (717)..(717): n is a, c, g, or t
  misc_feature (721)..(721): n is a, c, g, or t
  misc_feature (723)..(723): n is a, c, g, or t
  misc_feature (727)..(727): n is a, c, g, or t
  misc_feature (731)..(731): n is a, c, g, or t
  misc_feature (760)..(760): n is a, c, g, or t
  misc_feature (770)..(770): n is a, c, g, or t
  misc_feature (788)..(789): n is a, c, g, or t
  misc_feature (794)..(794): n is a, c, g, or t
  misc_feature (797)..(797): n is a, c, g, or t
  misc_feature (802)..(802): n is a, c, g, or t
  misc_feature (811)..(811): n is a, c, g, or t
  misc_feature (814)..(814): n is a, c, g, or t
  misc_feature (826)..(826): n is a, c, g, or t
  misc_feature (829)..(829): n is a, c, g, or t
  misc_feature (831)..(832): n is a, c, g, or t
  misc_feature (834)..(834): n is a, c, g, or t
  misc_feature (839)..(839): n is a, c, g, or t
nnatagagaaattactatgagaggatcgcatcaccatcaccatcacggatcctatttaggtgacactatagaatcgtcgacccacgcgtccgccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaanagcagtgccagcctccgacagccntcccaccaagcaagaggtgaagaaggcaggagagagacacaagctggnaaaggancggcgagaagagcgggncaagtacctggcggcnaagaaggcagtgtggctggagaaggangagaaggccaaggcgctgcggganaagcagctccaggancgccggngccggctggaggagcaacgtcttaaagccgagcaagcnntgcagncctgtangaacggcancggnanaagnttcnagaaaaacaatggatcgctatgaaagcanccattccaanggtcagtgaaaaaagacnntgggncgnaattncggcaacancgnctggtcctgggnagngnncncttgn

SEQ ID NO: 290 - DNA, 801 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (752)..(752): n is a, c, g, or t
  misc_feature (789)..(789): n is a, c, g, or t
  misc_feature (798)..(798): n is a, c, g, or t
nanctntgagaggatcgcatcaccatcaccatcacggatcctatttaggtgacactatagaatcgtcgacccacgcgtccgcccacgcgtccggtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattggaagaatggaaagaacttatctacaagggaagtaatgaattcagaagaaaagactaaaaatggtgtagtaaaanggacagcctttctccttcagcacaggtgcagcagtgnaacagcagngga

SEQ ID NO: 291 - DNA, 817 bp, Homo sapiens
  misc_feature (803)..(803): n is a, c, g, or t
cttaagaggagaattaactatgagaggatcgcatcaccatcaccatcacggatcctatttaggtgacactatagaatcgtcgacccacgcgtccgcggacgcgtgggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgaggggnaaaacgaccctgta

SEQ ID NO: 292 - DNA, 1256 bp, Homo sapiens
  misc_feature (1)..(1): n is a, c, g, or t
  misc_feature (810)..(810): n is a, c, g, or t
  misc_feature (843)..(843): n is a, c, g, or t
  misc_feature (865)..(865): n is a, c, g, or t
  misc_feature (868)..(868): n is a, c, g, or t
  misc_feature (873)..(873): n is a, c, g, or t
  misc_feature (891)..(891): n is a, c, g, or t
  misc_feature (915)..(915): n is a, c, g, or t
  misc_feature (926)..(926): n is a, c, g, or t
  misc_feature (932)..(932): n is a, c, g, or t
  misc_feature (934)..(935): n is a, c, g, or t
  misc_feature (941)..(941): n is a, c, g, or t
  misc_feature (945)..(945): n is a, c, g, or t
  misc_feature (947)..(947): n is a, c, g, or t
  misc_feature (956)..(956): n is a, c, g, or t
  misc_feature (960)..(960): n is a, c, g, or t
  misc_feature (966)..(966): n is a, c, g, or t
  misc_feature (970)..(970): n is a, c, g, or t
  misc_feature (979)..(979): n is a, c, g, or t
  misc_feature (986)..(986): n is a, c, g, or t
  misc_feature (993)..(993): n is a, c, g, or t
  misc_feature (1006)..(1006): n is a, c, g, or t
  misc_feature (1008)..(1008): n is a, c, g, or t
  misc_feature (1015)..(1015): n is a, c, g, or t
  misc_feature (1019)..(1020): n is a, c, g, or t
  misc_feature (1023)..(1023): n is a, c, g, or t
  misc_feature (1049)..(1049): n is a, c, g, or t
  misc_feature (1054)..(1055): n is a, c, g, or t
  misc_feature (1068)..(1068): n is a, c, g, or t
  misc_feature (1084)..(1086): n is a, c, g, or t
  misc_feature (1114)..(1115): n is a, c, g, or t
  misc_feature (1123)..(1124): n is a, c, g, or t
  misc_feature (1138)..(1138): n is a, c, g, or t
  misc_feature (1146)..(1146): n is a, c, g, or t
  misc_feature (1153)..(1153): n is a, c, g, or t
  misc_feature (1155)..(1155): n is a, c, g, or t
  misc_feature (1163)..(1164): n is a, c, g, or t
  misc_feature (1187)..(1188): n is a, c, g, or t
  misc_feature (1196)..(1196): n is a, c, g, or t
  misc_feature (1207)..(1207): n is a, c, g, or t
  misc_feature (1216)..(1216): n is a, c, g, or t
  misc_feature (1229)..(1229): n is a, c, g, or t
  misc_feature (1243)..(1244): n is a, c, g, or t
  misc_feature (1253)..(1253): n is a, c, g, or t
  misc_feature (1256)..(1256): n is a, c, g, or t
naattagagaaattactatgagaggatcgcatcaccatcaccatcacggatcctatttaggtgacactatagaatcgtcgacccacgcgtccggctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgcccccagctcgccacgctagctgacgaggtgtctgcctccctggccaagcagggtttgtgatcaggcccctgggggcggtcaataattgtgganaggaaaaaatgaaaaagtgtggaaaaaaaaaanaataatggaccggggcccccgnccntttgnccccaggttgctcctcgnaattcggttaaattggttaaaccncttaaacctgntttttntnnctcggntttngnctcgggaanttcnaaatcngtgngtggggaanaaaaaanaaatttntttttttccaaantngaagggngggnntantaataaaaaattttttaaaaaaaaanttttnnaaaaaattggccnattccaaaattttccnnngggaaatccctttttaaatttttttttnntccccccnncggtaaaaaaaggnaaaaaaanaaaagtntntaaaattnntttttgggggaattttaaggggnnggggggtnccaaacccccntggggcctnttggggggggttncaaaaagggggggnnaaaaaaaanatn

SEQ ID NO: 293 - DNA, 1122 bp, Homo sapiens
  misc_feature (826)..(826): n is a, c, g, or t
  misc_feature (882)..(882): n is a, c, g, or t
  misc_feature (887)..(887): n is a, c, g, or t
  misc_feature (900)..(900): n is a, c, g, or t
  misc_feature (911)..(911): n is a, c, g, or t
  misc_feature (919)..(919): n is a, c, g, or t
  misc_feature (923)..(923): n is a, c, g, or t
  misc_feature (942)..(942): n is a, c, g, or t
  misc_feature (952)..(952): n is a, c, g, or t
  misc_feature (956)..(956): n is a, c, g, or t
  misc_feature (962)..(962): n is a, c, g, or t
  misc_feature (988)..(988): n is a, c, g, or t
  misc_feature (1003)..(1003): n is a, c, g, or t
  misc_feature (1011)..(1012): n is a, c, g, or t
  misc_feature (1022)..(1022): n is a, c, g, or t
  misc_feature (1028)..(1028): n is a, c, g, or t
  misc_feature (1032)..(1032): n is a, c, g, or t
  misc_feature (1037)..(1037): n is a, c, g, or t
  misc_feature (1040)..(1040): n is a, c, g, or t
  misc_feature (1061)..(1061): n is a, c, g, or t
  misc_feature (1065)..(1065): n is a, c, g, or t
  misc_feature (1073)..(1074): n is a, c, g, or t
  misc_feature (1077)..(1077): n is a, c, g, or t
  misc_feature (1082)..(1082): n is a, c, g, or t
  misc_feature (1088)..(1088): n is a, c, g, or t
  misc_feature (1092)..(1092): n is a, c, g, or t
  misc_feature (1095)..(1095): n is a, c, g, or t
  misc_feature (1103)..(1103): n is a, c, g, or t
  misc_feature (1110)..(1110): n is a, c, g, or t
  misc_feature (1112)..(1112): n is a, c, g, or t
  misc_feature (1117)..(1117): n is a, c, g, or t
  misc_feature (1120)..(1121): n is a, c, g, or t
agagaattaactatgagaggatcgcatcaccatcaccatcacggatcctatttaggtgacactatagaatcgtcgacccacgcgtccgccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccganccgaacgacgggagtcgctgcaaaacaagaagccattcgtgaggtggactcctcanaggangacaccgaggaanggcctgaaaanagccaggngcanaggaactgaacttggcacntcacccaaantganccaaanggggccctaaaggaacaggaaaaaantgggaaaaagaatcntttccgtnnaaaaacctangaaccngggnccaanggnccaagcctattgaaagggatnaaantgggggcnnccnaaaanggaaantccnagnggtcccanaggaggntnggganccnna

SEQ ID NO: 294 - DNA, 1075 bp, Homo sapiens
  misc_feature (852)..(852): n is a, c, g, or t
  misc_feature (855)..(855): n is a, c, g, or t
  misc_feature (885)..(885): n is a, c, g, or t
  misc_feature (899)..(899): n is a, c, g, or t
  misc_feature (941)..(941): n is a, c, g, or t
  misc_feature (943)..(943): n is a, c, g, or t
  misc_feature (950)..(950): n is a, c, g, or t
  misc_feature (958)..(958): n is a, c, g, or t
  misc_feature (964)..(964): n is a, c, g, or t
  misc_feature (966)..(966): n is a, c, g, or t
  misc_feature (969)..(969): n is a, c, g, or t
  misc_feature (972)..(972): n is a, c, g, or t
  misc_feature (974)..(974): n is a, c, g, or t
  misc_feature (993)..(993): n is a, c, g, or t
  misc_feature (997)..(997): n is a, c, g, or t
  misc_feature (1002)..(1002): n is a, c, g, or t
  misc_feature (1007)..(1007): n is a, c, g, or t
  misc_feature (1010)..(1010): n is a, c, g, or t
  misc_feature (1013)..(1013): n is a, c, g, or t
  misc_feature (1015)..(1015): n is a, c, g, or t
  misc_feature (1026)..(1026): n is a, c, g, or t
  misc_feature (1033)..(1033): n is a, c, g, or t
  misc_feature (1047)..(1047): n is a, c, g, or t
  misc_feature (1058)..(1058): n is a, c, g, or t
  misc_feature (1061)..(1061): n is a, c, g, or t
  misc_feature (1070)..(1070): n is a, c, g, or t
  misc_feature (1073)..(1073): n is a, c, g, or t
agagagaattactatgagaggatcgcatcaccatcaccatcacggatcctatttaggtgacactatagaatcgtcgacccacgcgtccgagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccagnagnaaggccgtgctcctggcttccttcctcggnccgtcccacttccnggggcctcggggcacacagctggggctgcccccacccgaaanancctccangctcgtcntctaanantcnggntncggaaatgccgggtgctcntggncctgnctggntcntananctttgggctcnaggccantcctcccatgcccnttttccacttnttnaaatggaanaanca

SEQ ID NO: 295 - DNA, 864 bp, Homo sapiens
  misc_feature (549)..(549): n is a, c, g, or t
gggattactatgagaggtcgcatcaccatcaccatcacggatcctatttaggtgacactatagaatcgtcgactctggaccttggctgtcactcagttaccaacattgacttcttactcaacctgtctggccacccagagtttgaagctgggaacgtgcacactgatttcacccctcaacaccacaaacagttgttgctcagtcggaaggctgcagccaaagagcctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctgnaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatgggtatgatcgccatgaagatggagcataccataaagtctcaaaggatggcacagtaaagaaagtgttctacagaaaagtgctcaggccaacgacacactctttagtccagtggaggaggaaaatcaaccaagg

SEQ ID NO: 296 - DNA, 976 bp, Homo sapiens
  misc_feature (814)..(814): n is a, c, g, or t
  misc_feature (833)..(833): n is a, c, g, or t
  misc_feature (866)..(866): n is a, c, g, or t
  misc_feature (904)..(904): n is a, c, g, or t
  misc_feature (933)..(933): n is a, c, g, or t
  misc_feature (937)..(937): n is a, c, g, or t
  misc_feature (945)..(945): n is a, c, g, or t
  misc_feature (948)..(948): n is a, c, g, or t
  misc_feature (952)..(952): n is a, c, g, or t
  misc_feature (957)..(959): n is a, c, g, or t
  misc_feature (965)..(976): n is a, c, g, or t
tagagaaattactatgagaggatcgcatcaccatcaccatcacggatcctatttaggtgacactatagaatcgtcgacccacgcgtccgcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcanccctgggatcagctggaanctgcctgtcatctcctgcccaatccccaaaaanccctgattcaggtctgcaggctcctgcgggctcaccangctgctggctccggtacatgtaaacctangaangtaaagancangcancctcnnnaaaaannnnnnnnnnnn

SEQ ID NO: 297 - DNA, 1269 bp, Homo sapiens
  misc_feature (826)..(826): n is a, c, g, or t
  misc_feature (852)..(852): n is a, c, g, or t
  misc_feature (854)..(854): n is a, c, g, or t
  misc_feature (877)..(877): n is a, c, g, or t
  misc_feature (880)..(880): n is a, c, g, or t
  misc_feature (901)..(901): n is a, c, g, or t
  misc_feature (948)..(948): n is a, c, g, or t
  misc_feature (974)..(974): n is a, c, g, or t
  misc_feature (986)..(986): n is a, c, g, or t
  misc_feature (997)..(997): n is a, c, g, or t
  misc_feature (1007)..(1007): n is a, c, g, or t
  misc_feature (1011)..(1011): n is a, c, g, or t
  misc_feature (1013)..(1013): n is a, c, g, or t
  misc_feature (1020)..(1020): n is a, c, g, or t
  misc_feature (1023)..(1023): n is a, c, g, or t
  misc_feature (1031)..(1031): n is a, c, g, or t
  misc_feature (1054)..(1054): n is a, c, g, or t
  misc_feature (1056)..(1056): n is a, c, g, or t
  misc_feature (1062)..(1062): n is a, c, g, or t
  misc_feature (1064)..(1065): n is a, c, g, or t
  misc_feature (1080)..(1081): n is a, c, g, or t
  misc_feature (1089)..(1089): n is a, c, g, or t
  misc_feature (1093)..(1093): n is a, c, g, or t
  misc_feature (1098)..(1099): n is a, c, g, or t
  misc_feature (1112)..(1113): n is a, c, g, or t
  misc_feature (1129)..(1129): n is a, c, g, or t
  misc_feature (1137)..(1137): n is a, c, g, or t
  misc_feature (1139)..(1139): n is a, c, g, or t
  misc_feature (1147)..(1147): n is a, c, g, or t
  misc_feature (1151)..(1151): n is a, c, g, or t
  misc_feature (1154)..(1154): n is a, c, g, or t
  misc_feature (1156)..(1156): n is a, c, g, or t
  misc_feature (1165)..(1165): n is a, c, g, or t
  misc_feature (1171)..(1171): n is a, c, g, or t
  misc_feature (1190)..(1190): n is a, c, g, or t
  misc_feature (1199)..(1199): n is a, c, g, or t
  misc_feature (1204)..(1205): n is a, c, g, or t
  misc_feature (1212)..(1213): n is a, c, g, or t
  misc_feature (1222)..(1222): n is a, c, g, or t
  misc_feature (1240)..(1241): n is a, c, g, or t
  misc_feature (1248)..(1248): n is a, c, g, or t
  misc_feature (1256)..(1256): n is a, c, g, or t
  misc_feature (1259)..(1259): n is a, c, g, or t
tagagaaattactatgagaggatcgcatcaccatcaccatcacggatcctatttaggtgacactatagaatcgtcgacccacgcgtccgcttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatcccnagcaaatgttttggaggtccccccananagcaaagtgggccatggcaaaantanggggttggttggacctgtcanatgaaaatggatcagcactttgaatgggaaaaattggaaggaaaagnccttggcctgtccctgcggggaaatnttttatggaaanaagggctggancccactttanctgnanttttttnccnacttgggnaaaatggaaaaaggaacccttgnantttttntnncatcccccccccagnnaaggggcnaaanttgannttttaaaaacccnnaaattttgggggctgnaaaagggnangaaaaaantaanttnancccagcctnttaaanttttgggccccttaaaggnaaaaaaggnaaggnngggaaanntttgccttntttgggcccccctttttnncaattgnaaataaangcnaaaggggaaa

SEQ ID NO: 298 - DNA, 1380 bp, Homo sapiens
  misc_feature (8)..(11): n is a, c, g, or t
  misc_feature (966)..(966): n is a, c, g, or t
aatgaatnnnnggatatactgacttacctataaataggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatcggccgcgatccgcatgcgagctcgattagctgagcttggactcctgttgatagatccagtaatgacctcagaactccatctggatttgttcagaacgctcggttgccgccgggcgttttttattggtgagaatccaagctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaataagcacaagttttatccggccttatcacattcttggccgcctgatgatgctcatccggatttcnttggcaatgaaagacgggacctgggatatgggaaaaggttccccttgttaccccgttttcccgaacaaactgaacgttttcccccctggaaggaataccccgacatttccggggttcctcccatatattcccaaataggggcggtctacggtaaccccctccttttccctaagcaccatccgaaaataattttccctccacccacccccgggagatttacccattttcttacacttgtcctacgtgcaacactctccccctatttcccgatggcctaaataataacgcgataggttccacactacgccaacattggacctcctaccttcctctcacaatttgccctttacccaaccattccacctacaagtcgctctgtagcatcatctgaactacacgcccctctatgccaca

SEQ ID NO: 299 - DNA, 877 bp, Homo sapiens
  misc_feature (848)..(849): n is a, c, g, or t
agaattactatgagaggtcgcatcaccatcaccatcacggatcctatttaggtgacactatagaatcgtcgactctggaccttggctgtcactcagttaaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcaggttctctcccttttgataagcaaacaaccaagtcagagctgctgagccagctccagcagcatgaggaagagtcaagggcacagagagatgcaaagcgacctaaaatcagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagtttccattttacatgagcaggtttgatgatgatggtcagaattcatgacatatattctggagaacactgagagctttcaaacanngacatcgcattcatgagctgtgactgtg

SEQ ID NO: 300 - DNA, 1238 bp, Homo sapiens
  misc_feature (753)..(753): n is a, c, g, or t
  misc_feature (852)..(852): n is a, c, g, or t
  misc_feature (870)..(870): n is a, c, g, or t
  misc_feature (878)..(878): n is a, c, g, or t
  misc_feature (893)..(893): n is a, c, g, or t
  misc_feature (899)..(899): n is a, c, g, or t
  misc_feature (909)..(909): n is a, c, g, or t
  misc_feature (954)..(954): n is a, c, g, or t
  misc_feature (966)..(966): n is a, c, g, or t
  misc_feature (971)..(971): n is a, c, g, or t
  misc_feature (977)..(977): n is a, c, g, or t
  misc_feature (984)..(984): n is a, c, g, or t
  misc_feature (990)..(990): n is a, c, g, or t
  misc_feature (995)..(995): n is a, c, g, or t
  misc_feature (1003)..(1003): n is a, c, g, or t
  misc_feature (1006)..(1006): n is a, c, g, or t
  misc_feature (1024)..(1025): n is a, c, g, or t
  misc_feature (1033)..(1033): n is a, c, g, or t
  misc_feature (1035)..(1035): n is a, c, g, or t
  misc_feature (1037)..(1038): n is a, c, g, or t
  misc_feature (1044)..(1044): n is a, c, g, or t
  misc_feature (1046)..(1046): n is a, c, g, or t
  misc_feature (1057)..(1057): n is a, c, g, or t
  misc_feature (1082)..(1082): n is a, c, g, or t
  misc_feature (1087)..(1087): n is a, c, g, or t
  misc_feature (1092)..(1092): n is a, c, g, or t
  misc_feature (1102)..(1102): n is a, c, g, or t
  misc_feature (1105)..(1105): n is a, c, g, or t
  misc_feature (1113)..(1115): n is a, c, g, or t
  misc_feature (1123)..(1123): n is a, c, g, or t
  misc_feature (1127)..(1127): n is a, c, g, or t
  misc_feature (1151)..(1152): n is a, c, g, or t
  misc_feature (1154)..(1154): n is a, c, g, or t
  misc_feature (1184)..(1184): n is a, c, g, or t
  misc_feature (1197)..(1197): n is a, c, g, or t
  misc_feature (1201)..(1201): n is a, c, g, or t
  misc_feature (1203)..(1203): n is a, c, g, or t
  misc_feature (1210)..(1210): n is a, c, g, or t
  misc_feature (1227)..(1227): n is a, c, g, or t
  misc_feature (1231)..(1231): n is a, c, g, or t
  misc_feature (1234)..(1234): n is a, c, g, or t
attagagaaattactatgagaggatcgcatcaccatcaccatcacggatcctatttaggtgacactatagaatcgtcgacccacgcgtccgttaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaatttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctganggacacgaccccggtctgccgttgggcagcctcactgcgcccccagcccctgagccctcggcctgctcaaagcctggagaatgccctgcgaaaaaagangccgcgcctggatggcanccaaaagnccgcctgccgtgcanctggancccatggcancaggggccgcaccatcccccgggccggggccagggcccaaaaaantctgtgaccccncgcancacccncccgggntggggncccgncttccctnccnaagccttttgggggaatnnaaacaaantntnntttccntngcccggaattnccaaaaaacttggaaaaaaaaatgncccantcttnccaaaaaaanccnagggggtnnnaaattccnatgnggtttctatcctgggaggaaaaannanggaaaaaccaaggaacccccccaaaattcntttttaaaccccnaaancnccttttntttttaaaaaaaaaatnttanttntggc

SEQ ID NO: 301 - DNA, 1384 bp, Homo sapiens
gcatatatctgacttacctataaatggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggccggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaaggatctgctggaggaaggaaaggccaccgttccctgcctggcacaaaactttaccaccgaacccggccgcgaatccgcaatgcaagctccattaactgaacctcgaaccccgttgatacatcccgcaatggacccccgaactccctcaggattttgttcagaacccaccgcataacacaacgctccttcttctcactaaaactcccccaccacactccacactcagaccccccagacctcacacaaccacaaatggcccaaccaccccaccctgacaacccacactgcagcccactctaaccagacacccccctgacgcaccccaccaccccccactcacaccttacacctacctctataacacaccgacgcacctcagctaattcaacttcaccgctattcacctctgcacacacacatcagactcccaacaagaacactacctcagcccaaccacctgtctcaagccctaaaatcccactgacagtctacgacctatcgcgcactacagtggatcccatcatctctactctactccatcacgcctacatacccagctttcacaccttcatcaaacacaccacacctagatactcaaccctatcagcatcacg

SEQ ID NO: 302 - DNA, 777 bp, Homo sapiens
  misc_feature (682)..(682): n is a, c, g, or t
  misc_feature (751)..(751): n is a, c, g, or t
  misc_feature (755)..(777): n is a, c, g, or t
atagagagatactatgagaggtcgcatcaccatcaccatcacggatcctatttaggtgacactatagaatcgtcgactctggaccttggctgtcactcagttgggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgaccccatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaagatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgangcagctgtgggtgcccctgctgtgtggctctgtatgactgttgctgaaatataaagcccctgcacctgncaannnnnnnnnnnnnnnnnnnnnnn

SEQ ID NO: 303 - DNA, 1100 bp, Homo sapiens
  misc_feature (1)..(1): n is a, c, g, or t
  misc_feature (16)..(16): n is a, c, g, or t
  misc_feature (740)..(740): n is a, c, g, or t
  misc_feature (776)..(776): n is a, c, g, or t
  misc_feature (804)..(804): n is a, c, g, or t
  misc_feature (816)..(816): n is a, c, g, or t
  misc_feature (840)..(840): n is a, c, g, or t
  misc_feature (844)..(844): n is a, c, g, or t
  misc_feature (866)..(866): n is a, c, g, or t
  misc_feature (891)..(891): n is a, c, g, or t
  misc_feature (894)..(894): n is a, c, g, or t
  misc_feature (906)..(906): n is a, c, g, or t
  misc_feature (916)..(916): n is a, c, g, or t
  misc_feature (930)..(930): n is a, c, g, or t
  misc_feature (935)..(935): n is a, c, g, or t
  misc_feature (938)..(938): n is a, c, g, or t
  misc_feature (961)..(961): n is a, c, g, or t
  misc_feature (973)..(973): n is a, c, g, or t
  misc_feature (975)..(975): n is a, c, g, or t
  misc_feature (982)..(982): n is a, c, g, or t
  misc_feature (986)..(986): n is a, c, g, or t
  misc_feature (988)..(988): n is a, c, g, or t
  misc_feature (996)..(996): n is a, c, g, or t
  misc_feature (1005)..(1005): n is a, c, g, or t
  misc_feature (1008)..(1008): n is a, c, g, or t
  misc_feature (1013)..(1013): n is a, c, g, or t
  misc_feature (1024)..(1024): n is a, c, g, or t
  misc_feature (1032)..(1032): n is a, c, g, or t
  misc_feature (1034)..(1034): n is a, c, g, or t
  misc_feature (1036)..(1036): n is a, c, g, or t
  misc_feature (1038)..(1038): n is a, c, g, or t
  misc_feature (1047)..(1047): n is a, c, g, or t
  misc_feature (1054)..(1054): n is a, c, g, or t
  misc_feature (1059)..(1059): n is a, c, g, or t
  misc_feature (1070)..(1070): n is a, c, g, or t
  misc_feature (1075)..(1075): n is a, c, g, or t
  misc_feature (1078)..(1079): n is a, c, g, or t
  misc_feature (1082)..(1082): n is a, c, g, or t
  misc_feature (1091)..(1091): n is a, c, g, or t
  misc_feature (1099)..(1099): n is a, c, g, or t
naattagagaaattanctatgagaggatcgcatcaccatcaccatcacggatcctatttaggtgacactatagaatcgtcgacccacgcgtccgtgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagancctgcccgccggcaccctcctgcacttaaagctcanctccgtggcagccggcaagggtgattcngacctcatggancctgtattccgatacctggccaangaangctgtgctctaacccacctgancctgtctgcaaaccacctggggganaangctgttaaaaanctgtgcaaangtctctctctgtgnccctncantcatctcactggatttgtctgcnaaccctgaaatnanctgtgcnactngnaaaactcntgtccaccntcnaaaancggccccaagncttaactncntngnctgtcaggntgccccntcaanggtccctgggnctggnctnnggnaaaaaaaancccccaant

SEQ ID NO: 304 - DNA, 1215 bp, Homo sapiens
  misc_feature (815)..(815): n is a, c, g, or t
  misc_feature (905)..(905): n is a, c, g, or t
  misc_feature (945)..(945): n is a, c, g, or t
  misc_feature (957)..(957): n is a, c, g, or t
  misc_feature (970)..(970): n is a, c, g, or t
  misc_feature (1002)..(1002): n is a, c, g, or t
  misc_feature (1006)..(1006): n is a, c, g, or t
  misc_feature (1013)..(1013): n is a, c, g, or t
  misc_feature (1017)..(1017): n is a, c, g, or t
  misc_feature (1026)..(1026): n is a, c, g, or t
  misc_feature (1028)..(1028): n is a, c, g, or t
  misc_feature (1042)..(1042): n is a, c, g, or t
  misc_feature (1048)..(1048): n is a, c, g, or t
  misc_feature (1067)..(1067): n is a, c, g, or t
  misc_feature (1070)..(1070): n is a, c, g, or t
  misc_feature (1087)..(1087): n is a, c, g, or t
  misc_feature (1095)..(1095): n is a, c, g, or t
  misc_feature (1100)..(1100): n is a, c, g, or t
  misc_feature (1102)..(1102): n is a, c, g, or t
  misc_feature (1106)..(1106): n is a, c, g, or t
  misc_feature (1116)..(1116): n is a, c, g, or t
  misc_feature (1120)..(1120): n is a, c, g, or t
  misc_feature (1124)..(1124): n is a, c, g, or t
  misc_feature (1126)..(1126): n is a, c, g, or t
  misc_feature (1138)..(1138): n is a, c, g, or t
  misc_feature (1151)..(1151): n is a, c, g, or t
  misc_feature (1154)..(1154): n is a, c, g, or t
  misc_feature (1157)..(1157): n is a, c, g, or t
  misc_feature (1170)..(1170): n is a, c, g, or t
  misc_feature (1172)..(1172): n is a, c, g, or t
  misc_feature (1175)..(1175): n is a, c, g, or t
  misc_feature (1180)..(1180): n is a, c, g, or t
  misc_feature (1194)..(1194): n is a, c, g, or t
  misc_feature (1205)..(1205): n is a, c, g, or t
  misc_feature (1211)..(1213): n is a, c, g, or t
  misc_feature (1215)..(1215): n is a, c, g, or t
tagagaaattactatgagaggatcgcatcaccatcaccatcacggatcctatttaggtgacactatagaatcgtcgacccacgcgtccggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcaganggctggtcgcatcgaagcccaccttagccacgctgagtgtccgcttctcagcaacctcgatgaaggaagtccttgttcctgaagcctcanaatttgatgagtgggagcctgaaggcacaaccctagaagncctgtgactgcngtcatccccactnggcaggcattgaccccgcttgaacctggaccncaanagcattntccnaaatcgacnantctgtgaaatgatncccaanattgatttctggacctgantcnaatggattgctggttgnggaaatcngcacncntgtnaacttgggcnttgnactntnctaaaaaagctncctcttggaaggnttnccnccagttggggaantncanacttnacctgggggcaccnctaaagttganggccgnnnan

SEQ ID NO: 305 - DNA, 888 bp, Homo sapiens
  misc_feature (2)..(2): n is a, c, g, or t
  misc_feature (648)..(648): n is a, c, g, or t
  misc_feature (650)..(650): n is a, c, g, or t
  misc_feature (672)..(672): n is a, c, g, or t
  misc_feature (695)..(695): n is a, c, g, or t
  misc_feature (733)..(733): n is a, c, g, or t
  misc_feature (737)..(737): n is a, c, g, or t
  misc_feature (740)..(740): n is a, c, g, or t
  misc_feature (747)..(747): n is a, c, g, or t
  misc_feature (754)..(754): n is a, c, g, or t
  misc_feature (760)..(760): n is a, c, g, or t
  misc_feature (765)..(765): n is a, c, g, or t
  misc_feature (769)..(769): n is a, c, g, or t
  misc_feature (805)..(805): n is a, c, g, or t
  misc_feature (807)..(807): n is a, c, g, or t
  misc_feature (828)..(828): n is a, c, g, or t
  misc_feature (831)..(831): n is a, c, g, or t
  misc_feature (842)..(843): n is a, c, g, or t
  misc_feature (846)..(846): n is a, c, g, or t
  misc_feature (858)..(858): n is a, c, g, or t
  misc_feature (876)..(876): n is a, c, g, or t
  misc_feature (881)..(881): n is a, c, g, or t
cnatgagaggatcgcatcaccatcaccatcacggatcctatttaggtgacactatagaatcgtcgacccacgcgtccgctccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacactgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatccctgtgctctacccccaaggntnccgggctcatcgttcacctttngacgagcatgtcatcaagcaatnaacttccaagtttgggggtccttttatcagaaagcttngggnaanacctccngaggaanaaactnctttncgcncccaatgggggaaaagtcccccccttttcggggggngntcccttggaaatttccttggnccnagaaagggtcnnaanttggcagggacnttttaaagggggtttccngaagngaaggcc

SEQ ID NO: 306 - DNA, 752 bp, Homo sapiens
  misc_feature (584)..(584): n is a, c, g, or t
  misc_feature (608)..(608): n is a, c, g, or t
  misc_feature (622)..(622): n is a, c, g, or t
  misc_feature (639)..(639): n is a, c, g, or t
  misc_feature (649)..(649): n is a, c, g, or t
  misc_feature (677)..(677): n is a, c, g, or t
  misc_feature (680)..(680): n is a, c, g, or t
  misc_feature (703)..(704): n is a, c, g, or t
  misc_feature (708)..(708): n is a, c, g, or t
  misc_feature (710)..(710): n is a, c, g, or t
  misc_feature (718)..(718): n is a, c, g, or t
  misc_feature (720)..(720): n is a, c, g, or t
  misc_feature (723)..(723): n is a, c, g, or t
  misc_feature (730)..(730): n is a, c, g, or t
  misc_feature (739)..(741): n is a, c, g, or t
  misc_feature (745)..(750): n is a, c, g, or t
tagagaaattactatgagaggatcgcatcaccatcaccatcacggatcctatttaggtgacactatagaatcgtcgacccacgcgtccggcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaggattgcttcagcccgggagttcgagaccagcctgggcaacacaggaagaccccgtctctaccagaaaaacataaaaattagccaagtgtggtggcacgcacctgtggtcccaactactcgggaggctgaagcaggaggactgcttgagctgagtccnaggttacagtgagccgtgattganccactgcactccancctcggccacagtgcangactgtgtcncttaaaaaaaaatttttttttttttganacngaatttttgctcttgttgcccannctgnantgcactgncncanccttccncctccctgnnnttcnnnnnnat

SEQ ID NO: 307 - DNA, 872 bp, Homo sapiens
aagagattactatgagaggtcgcatcaccatcaccatcacggatcctatttaggtgacactatagaatcgtcgactctggaccttggctgtcactcagttggaagtgttaagagacccaaagcccggagagtgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggttttcaggaagtattgagattctgctttggagggtaaagtggggaaagaaatcgattcccagaggtgaatcagctcctctcctacttgtgactagagggtggtggaggtaaggccttccagagcccatggcttcaagagagggtctctctccaggactgccaggctgctggaagactgcccctactgctgcat

SEQ ID NO: 308 - DNA, 1213 bp, Homo sapiens
  misc_feature (3)..(3): n is a, c, g, or t
  misc_feature (925)..(925): n is a, c, g, or t
  misc_feature (935)..(935): n is a, c, g, or t
  misc_feature (939)..(939): n is a, c, g, or t
  misc_feature (941)..(941): n is a, c, g, or t
  misc_feature (948)..(948): n is a, c, g, or t
  misc_feature (986)..(986): n is a, c, g, or t
  misc_feature (989)..(989): n is a, c, g, or t
  misc_feature (991)..(991): n is a, c, g, or t
  misc_feature (1001)..(1001): n is a, c, g, or t
  misc_feature (1014)..(1014): n is a, c, g, or t
  misc_feature (1021)..(1021): n is a, c, g, or t
  misc_feature (1031)..(1031): n is a, c, g, or t
  misc_feature (1049)..(1049): n is a, c, g, or t
  misc_feature (1053)..(1053): n is a, c, g, or t
  misc_feature (1056)..(1056): n is a, c, g, or t
  misc_feature (1069)..(1069): n is a, c, g, or t
  misc_feature (1082)..(1082): n is a, c, g, or t
  misc_feature (1090)..(1090): n is a, c, g, or t
  misc_feature (1100)..(1100): n is a, c, g, or t
  misc_feature (1108)..(1108): n is a, c, g, or t
  misc_feature (1115)..(1115): n is a, c, g, or t
  misc_feature (1129)..(1129): n is a, c, g, or t
  misc_feature (1138)..(1138): n is a, c, g, or t
  misc_feature (1146)..(1146): n is a, c, g, or t
  misc_feature (1153)..(1153): n is a, c, g, or t
  misc_feature (1162)..(1162): n is a, c, g, or t
  misc_feature (1172)..(1172): n is a, c, g, or t
  misc_feature (1175)..(1175): n is a, c, g, or t
  misc_feature (1177)..(1177): n is a, c, g, or t
  misc_feature (1182)..(1182): n is a, c, g, or t
  misc_feature (1185)..(1185): n is a, c, g, or t
  misc_feature (1196)..(1196): n is a, c, g, or t
  misc_feature (1204)..(1204): n is a, c, g, or t
  misc_feature (1207)..(1207): n is a, c, g, or t
atngagaaattactatgagaggatcgcatcaccatcaccatcacggatcctatttaggtgacactatagaatcgtcgacccacgcgtccgagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcaaaaaaatctacncttctttgcnccanantatgganaagtcactaatgtgacaacagcagtggacatctactcnttngncatgtgtgcnctggaaatggcantgcttgnaaattcaggncaatggaaagtcctcatntgtnccnaaggaagccctcngcagtgccctccngcttctanaaaacccttncagagggnttttttncaaagtgcctgcantttgacctnttccaaancaaaacnaaaaaattntgttcccccnacntnttganggncctccttaaantcttgggnccntggttg

SEQ ID NO: 309 - DNA, 1147 bp, Homo sapiens
  misc_feature (912)..(912): n is a, c, g, or t
  misc_feature (922)..(922): n is a, c, g, or t
  misc_feature (926)..(926): n is a, c, g, or t
  misc_feature (952)..(952): n is a, c, g, or t
  misc_feature (958)..(958): n is a, c, g, or t
  misc_feature (960)..(960): n is a, c, g, or t
  misc_feature (984)..(984): n is a, c, g, or t
  misc_feature (994)..(994): n is a, c, g, or t
  misc_feature (1004)..(1004): n is a, c, g, or t
  misc_feature (1058)..(1058): n is a, c, g, or t
  misc_feature (1061)..(1061): n is a, c, g, or t
  misc_feature (1076)..(1076): n is a, c, g, or t
  misc_feature (1079)..(1079): n is a, c, g, or t
  misc_feature (1084)..(1085): n is a, c, g, or t
  misc_feature (1087)..(1087): n is a, c, g, or t
  misc_feature (1097)..(1097): n is a, c, g, or t
  misc_feature (1102)..(1102): n is a, c, g, or t
  misc_feature (1107)..(1107): n is a, c, g, or t
  misc_feature (1121)..(1122): n is a, c, g, or t
  misc_feature (1127)..(1127): n is a, c, g, or t
  misc_feature (1130)..(1130): n is a, c, g, or t
  misc_feature (1139)..(1139): n is a, c, g, or t
  misc_feature (1146)..(1146): n is a, c, g, or t
tagagaaattactatgagaggatcgcatcaccatcaccatcacggatcctatttaggtgacactatagaatcgtcgacccacgcgtccgatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattantctggatggngtanacgttcctcttggggaccgggattcntctggngngaatgacccctctctactatttancgagtacatngtctatgaanttgctcaggtaaatctgaagtatctgctgaaactgaaattcatttttaaaaccnccngggggtattgggganagntagcnnantccccccggnggctntggtngaatttccccgaanngtttntgnaccaattcnctgggcnc

SEQ ID NO: 310 - DNA, 871 bp, Homo sapiens
  misc_feature (680)..(680): n is a, c, g, or t
  misc_feature (750)..(751): n is a, c, g, or t
  misc_feature (756)..(756): n is a, c, g, or t
  misc_feature (766)..(766): n is a, c, g, or t
  misc_feature (826)..(826): n is a, c, g, or t
  misc_feature (843)..(843): n is a, c, g, or t
  misc_feature (851)..(851): n is a, c, g, or t
  misc_feature (868)..(868): n is a, c, g, or t
taaggaattactatgagaggtcgcatcaccatcaccatcacggatcctatttaggtgacactatagaatcgtcgactctggaccttggctgtcactcagttaaggaagtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctncatgggcagctgcggtccatcttggtcaggacaccaggccatgaaggagatgcacttccaccccaggccnntaagnacgtgagggncagatcgggcgccatgcctgggaagtgataaatcaagtggtgcaggggcaggtgccaggncagcccctggtgtgtcntgcatganatgaaaatggtgactcncct

SEQ ID NO: 311 - DNA, 1096 bp, Homo sapiens
  misc_feature (3)..(3): n is a, c, g, or t
  misc_feature (809)..(809): n is a, c, g, or t
  misc_feature (882)..(882): n is a, c, g, or t
  misc_feature (901)..(901): n is a, c, g, or t
  misc_feature (924)..(924): n is a, c, g, or t
  misc_feature (929)..(929): n is a, c, g, or t
  misc_feature (951)..(951): n is a, c, g, or t
  misc_feature (956)..(956): n is a, c, g, or t
  misc_feature (958)..(958): n is a, c, g, or t
  misc_feature (961)..(961): n is a, c, g, or t
  misc_feature (973)..(973): n is a, c, g, or t
  misc_feature (983)..(983): n is a, c, g, or t
  misc_feature (985)..(985): n is a, c, g, or t
  misc_feature (995)..(995): n is a, c, g, or t
  misc_feature (997)..(997): n is a, c, g, or t
  misc_feature (1019)..(1019): n is a, c, g, or t
  misc_feature (1031)..(1031): n is a, c, g, or t
  misc_feature (1034)..(1034): n is a, c, g, or t
  misc_feature (1039)..(1039): n is a, c, g, or t
  misc_feature (1041)..(1041): n is a, c, g, or t
  misc_feature (1045)..(1045): n is a, c, g, or t
  misc_feature (1049)..(1049): n is a, c, g, or t
  misc_feature (1053)..(1054): n is a, c, g, or t
  misc_feature (1060)..(1060): n is a, c, g, or t
  misc_feature (1067)..(1067): n is a, c, g, or t
  misc_feature (1070)..(1070): n is a, c, g, or t
  misc_feature (1085)..(1085): n is a, c, g, or t
  misc_feature (1092)..(1092): n is a, c, g, or t
  misc_feature (1095)..(1095): n is a, c, g, or t
tantagagagattactatgagaggatcgcatcaccatcaccatcacggatcctatttaggtgacactatagaatcgtcgacccacgcgtccgctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcanatatcaccgagctcccggagaaatccgacaaggacagctcgagcgcctacaacacaggcgagagctgccgcancaccccgctcaccctgganatctcccccgacaactccttgangaaancggcggaaggcatcactgcccnaacancnaangggctgtggggnaccacggaancntacgggccancntccaaaaatctgctctccatcncggaaaatcccnaantgggncncccntacntatnncccgtncctgaangancttggaccccaccancccctgnaanc

SEQ ID NO: 312 - DNA, 1094 bp, Homo sapiens
  misc_feature (788)..(788): n is a, c, g, or t
  misc_feature (862)..(862): n is a, c, g, or t
  misc_feature (870)..(870): n is a, c, g, or t
  misc_feature (882)..(882): n is a, c, g, or t
  misc_feature (907)..(907): n is a, c, g, or t
  misc_feature (920)..(920): n is a, c, g, or t
  misc_feature (922)..(922): n is a, c, g, or t
  misc_feature (931)..(931): n is a, c, g, or t
  misc_feature (956)..(956): n is a, c, g, or t
  misc_feature (992)..(992): n is a, c, g, or t
  misc_feature (995)..(995): n is a, c, g, or t
  misc_feature (1009)..(1009): n is a, c, g, or t
  misc_feature (1017)..(1017): n is a, c, g, or t
  misc_feature (1020)..(1020): n is a, c, g, or t
  misc_feature (1030)..(1030): n is a, c, g, or t
  misc_feature (1033)..(1033): n is a, c, g, or t
  misc_feature (1035)..(1035): n is a, c, g, or t
  misc_feature (1043)..(1043): n is a, c, g, or t
  misc_feature (1049)..(1049): n is a, c, g, or t
  misc_feature (1054)..(1054): n is a, c, g, or t
  misc_feature (1060)..(1060): n is a, c, g, or t
  misc_feature (1062)..(1062): n is a, c, g, or t
  misc_feature (1064)..(1064): n is a, c, g, or t
  misc_feature (1074)..(1074): n is a, c, g, or t
  misc_feature (1080)..(1081): n is a, c, g, or t
  misc_feature (1084)..(1085): n is a, c, g, or t
  misc_feature (1087)..(1087): n is a, c, g, or t
  misc_feature (1092)..(1092): n is a, c, g, or t
  misc_feature (1094)..(1094): n is a, c, g, or t
tagagaaattactatgagaggatcgcatcaccatcaccatcacggatcctatttaggtgacactatagaatcgtcgacccacgcgtccgcggacgcgtgggcggacgcgtgggtcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcanaaaggacctgcattttcctacattgaggagctgacataggggtaaggtatgggagaggtaggtggatccagggnaaaagcantggggacggaangctttttcaaaaaacattaaattcncatgcagtctcananactatttanacaaagttcagttaggagcttttangatgggggagtaaactttaatgggaagggaaggctnggntgctggaaaaaagnaaaaaccnaantgggttaaanagnantcttaaantcctancccancctaangngncctgcccctntggccnntgnngnaaaancn

SEQ ID NO: 313 - DNA, 873 bp, Homo sapiens
  misc_feature (1)..(2): n is a, c, g, or t
  misc_feature (781)..(782): n is a, c, g, or t
  misc_feature (792)..(792): n is a, c, g, or t
nnggaaggatatggaagtgacgtgagaggatgcatcccatcaccatcacggatcctatttaggtgacactatagaatcgtcgactctggaccttggctgtcactcagttagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagagaatccnntcctccctgnacaaagtgctgacagctgctgaagtgcctctcatattcagctgagctgatctgactctgagggtgggctgcactattttat

SEQ ID NO: 314 - DNA, 1114 bp, Homo sapiens
  misc_feature (829)..(829): n is a, c, g, or t
  misc_feature (932)..(932): n is a, c, g, or t
  misc_feature (936)..(936): n is a, c, g, or t
  misc_feature (940)..(940): n is a, c, g, or t
  misc_feature (984)..(984): n is a, c, g, or t
  misc_feature (987)..(987): n is a, c, g, or t
  misc_feature (1010)..(1010): n is a, c, g, or t
  misc_feature (1016)..(1016): n is a, c, g, or t
  misc_feature (1022)..(1023): n is a, c, g, or t
  misc_feature (1031)..(1031): n is a, c, g, or t
  misc_feature (1033)..(1033): n is a, c, g, or t
  misc_feature (1036)..(1036): n is a, c, g, or t
  misc_feature (1040)..(1040): n is a, c, g, or t
  misc_feature (1042)..(1042): n is a, c, g, or t
  misc_feature (1044)..(1044): n is a, c, g, or t
  misc_feature (1050)..(1050): n is a, c, g, or t
  misc_feature (1064)..(1064): n is a, c, g, or t
  misc_feature (1071)..(1071): n is a, c, g, or t
  misc_feature (1078)..(1078): n is a, c, g, or t
  misc_feature (1096)..(1096): n is a, c, g, or t
  misc_feature (1100)..(1100): n is a, c, g, or t
  misc_feature (1104)..(1104): n is a, c, g, or t
  misc_feature (1114)..(1114): n is a, c, g, or t
tagagaaattactatgagaggatcgcatcaccatcaccatcacggatcctatttaggtgacactatagaatcgtcgacccacgcgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcanacctgagctgaagaacagcgtgggcagggagggaaaagacccagggtctggacacttcctccaacacaaaacctttcccaaccaacttcctggtccctccccntcgnccanattgtaaataatcaaaaacttgttctatttttggggcatgacantanttttatattaaaaaaaaaataangttttncatacnncaaaatcnanacnaaancntngttttnttaaaaaaaaatcnctacccncccttcnttccagggttcccccccncccntttnttttcctttn

SEQ ID NO: 315 - DNA, 548 bp, Homo sapiens
  misc_feature (5)..(5): n is a, c, g, or t
  misc_feature (36)..(36): n is a, c, g, or t
  misc_feature (38)..(38): n is a, c, g, or t
  misc_feature (46)..(46): n is a, c, g, or t
  misc_feature (68)..(68): n is a, c, g, or t
  misc_feature (431)..(431): n is a, c, g, or t
  misc_feature (452)..(452): n is a, c, g, or t
  misc_feature (457)..(457): n is a, c, g, or t
  misc_feature (470)..(470): n is a, c, g, or t
  misc_feature (475)..(475): n is a, c, g, or t
  misc_feature (483)..(483): n is a, c, g, or t
  misc_feature (504)..(504): n is a, c, g, or t
  misc_feature (507)..(507): n is a, c, g, or t
  misc_feature (521)..(521): n is a, c, g, or t
  misc_feature (524)..(526): n is a, c, g, or t
  misc_feature (530)..(531): n is a, c, g, or t
  misc_feature (540)..(543): n is a, c, g, or t
gaatntaaaaattatttgctttgtgagcggatacantntatgattnattgtgagcggataacaatttncacagaattattaaagaggagaaattaactatgagaggatcgcatcaccatcaccatcacggatcctatttaggtgacactatagaatcgtcgacccacgcgtccggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtnatcaacgcagctgagaaactncaggnggtggggcagggnctggnacaggtgnggacaatgtggatctggaggncgnaacaaaggaagggnatnnntggnnatgaacacnnnnaatgg

SEQ ID NO: 316 - DNA, 1251 bp, Homo sapiens
  misc_feature (858)..(858): n is a, c, g, or t
  misc_feature (892)..(892): n is a, c, g, or t
  misc_feature (899)..(899): n is a, c, g, or t
  misc_feature (901)..(901): n is a, c, g, or t
  misc_feature (941)..(941): n is a, c, g, or t
  misc_feature (945)..(945): n is a, c, g, or t
  misc_feature (972)..(972): n is a, c, g, or t
  misc_feature (976)..(976): n is a, c, g, or t
  misc_feature (986)..(986): n is a, c, g, or t
  misc_feature (997)..(997): n is a, c, g, or t
  misc_feature (1001)..(1001): n is a, c, g, or t
  misc_feature (1005)..(1005): n is a, c, g, or t
  misc_feature (1015)..(1015): n is a, c, g, or t
  misc_feature (1030)..(1030): n is a, c, g, or t
  misc_feature (1038)..(1038): n is a, c, g, or t
  misc_feature (1041)..(1042): n is a, c, g, or t
  misc_feature (1045)..(1045): n is a, c, g, or t
  misc_feature (1066)..(1066): n is a, c, g, or t
  misc_feature (1070)..(1070): n is a, c, g, or t
  misc_feature (1073)..(1073): n is a, c, g, or t
  misc_feature (1079)..(1079): n is a, c, g, or t
  misc_feature (1081)..(1081): n is a, c, g, or t
  misc_feature (1092)..(1092): n is a, c, g, or t
  misc_feature (1096)..(1096): n is a, c, g, or t
  misc_feature (1098)..(1098): n is a, c, g, or t
  misc_feature (1100)..(1100): n is a, c, g, or t
  misc_feature (1122)..(1122): n is a, c, g, or t
  misc_feature (1126)..(1126): n is a, c, g, or t
  misc_feature (1147)..(1147): n is a, c, g, or t
  misc_feature (1152)..(1152): n is a, c, g, or t
  misc_feature (1158)..(1158): n is a, c, g, or t
  misc_feature (1193)..(1193): n is a, c, g, or t
  misc_feature (1195)..(1195): n is a, c, g, or t
  misc_feature (1200)..(1200): n is a, c, g, or t
  misc_feature (1205)..(1205): n is a, c, g, or t
  misc_feature (1212)..(1212): n is a, c, g, or t
  misc_feature (1214)..(1214): n is a, c, g, or t
  misc_feature (1216)..(1216): n is a, c, g, or t
  misc_feature (1224)..(1224): n is a, c, g, or t
  misc_feature (1240)..(1240): n is a, c, g, or t
  misc_feature (1242)..(1242): n is a, c, g, or t
  misc_feature (1244)..(1245): n is a, c, g, or t
  misc_feature (1251)..(1251): n is a, c, g, or t
aaagagaaattactatgagaggatcgcatcaccatcaccatcacggatcctatttaggtgacactatagaatcgtcgacccacgcgtccgcgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaaanccctctttggcagaaagaagaaaattaagaatcntgcccangnaaaggatgaagtctccggttttggtgagcggcctcatgcnccanatccgtttggccatcaggatgccaggnccanaaggctccancaacttttggnccancccntgtcagcctngttaaaaaaacaccntgaaaaanagnntcncccccgtgggaaactggcaancaanggnaaatgnantttaaaaaagntttnantntggccccaaaaaatggaatccncccntttgtgtctcgaaaaattttnaaacncttttncccccacggaaaaaaaacccggccccctgggccancnaaaanccttnggggggntnanaaaggggnttaaaacccaaaaaantncnntttggn

SEQ ID NO: 317 - DNA, 2697 bp, Homo sapiens
atggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagt

SEQ ID NO: 318 - DNA, 847 bp, Homo sapiens
  misc_feature (816)..(816): n is a, c, g, or t
agaaatactatgagaggtcgcatcccatcaccatcacggatcctatttaggtgacactatagaatcgtcgactctggaccttggctgtcactcagttgaaaagaggcggagctgcaggggtggttggctgaggctggcttctgcgtggtgcagctgcgcacgtgtttcagccggcagcgctttaagatttccggggatggaatccgaaatggaaacgcagagcgccggggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaggaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaacaaattcaccatagagaatgtgacacggaccaggatagttttggctgatgtngaagtcacatccttggctccttcaaatatca

SEQ ID NO: 319 - DNA, 880 bp, Homo sapiens
  misc_feature (1)..(3): n is a, c, g, or t
  misc_feature (656)..(656): n is a, c, g, or t
  misc_feature (693)..(693): n is a, c, g, or t
  misc_feature (716)..(716): n is a, c, g, or t
  misc_feature (750)..(750): n is a, c, g, or t
  misc_feature (783)..(783): n is a, c, g, or t
  misc_feature (785)..(785): n is a, c, g, or t
  misc_feature (794)..(794): n is a, c, g, or t
  misc_feature (802)..(803): n is a, c, g, or t
  misc_feature (806)..(806): n is a, c, g, or t
  misc_feature (810)..(810): n is a, c, g, or t
  misc_feature (812)..(812): n is a, c, g, or t
  misc_feature (814)..(814): n is a, c, g, or t
  misc_feature (821)..(821): n is a, c, g, or t
  misc_feature (829)..(830): n is a, c, g, or t
  misc_feature (837)..(837): n is a, c, g, or t
  misc_feature (859)..(859): n is a, c, g, or t
  misc_feature (863)..(863): n is a, c, g, or t
  misc_feature (873)..(874): n is a, c, g, or t
  misc_feature (878)..(878): n is a, c, g, or t
nnntagagagaattactatgagaggatcgcatcaccatcaccatcacggatcctatttaggtgacactatagaatcgtcgacccacgcgtccgcccacgcgtccgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgccttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaancactacgggcctggctgggtgagcatggccaacgcangcaaagacaccaacggctcccanttcttcatcacgacagtcaagacagcctggctanatggcaagcatgtggtgtttggcaaagttctananggcatgtangtggtgcnnaangtgnanancaccaanaaagacannccggganaaaacccctgaaggatgtgatnatcncaaactgcgnnaaantt

SEQ ID NO: 320 - DNA, 738 bp, Homo sapiens
  misc_feature (1)..(1): n is a, c, g, or t
  misc_feature (3)..(3): n is a, c, g, or t
  misc_feature (499)..(500): n is a, c, g, or t
  misc_feature (510)..(510): n is a, c, g, or t
  misc_feature (557)..(557): n is a, c, g, or t
  misc_feature (560)..(560): n is a, c, g, or t
  misc_feature (591)..(591): n is a, c, g, or t
  misc_feature (594)..(594): n is a, c, g, or t
  misc_feature (644)..(644): n is a, c, g, or t
  misc_feature (649)..(649): n is a, c, g, or t
  misc_feature (657)..(657): n is a, c, g, or t
  misc_feature (668)..(668): n is a, c, g, or t
  misc_feature (671)..(671): n is a, c, g, or t
  misc_feature (685)..(685): n is a, c, g, or t
  misc_feature (695)..(695): n is a, c, g, or t
  misc_feature (698)..(698): n is a, c, g, or t
  misc_feature (711)..(711): n is a, c, g, or t
  misc_feature (714)..(714): n is a, c, g, or t
  misc_feature (716)..(717): n is a, c, g, or t
  misc_feature (720)..(721): n is a, c, g, or t
  misc_feature (723)..(723): n is a, c, g, or t
  misc_feature (726)..(726): n is a, c, g, or t
  misc_feature (732)..(732): n is a, c, g, or t
  misc_feature (734)..(734): n is a, c, g, or t
nanttagagaaattactatgagaggatcgcatcaccatcaccatcacggatcctatttaggtgacactatagaatcgtcgacccacgcgtccgccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccgggnncgcttcgtanagcggcccctcccggcctccaaggaggatctggtgtgcacaccgcancantaccgagcctcgggcagctacttcggcctgnaanagaacggccgcctcttcgcgccgccaagtcccgagacgggcgaggcgaancgcancgccttcntggaggtgaanaangctgcccgcgcggncagcctgcangangaggggacagccnacngnncgnnantcncctccnangacc

SEQ ID NO: 321 - DNA, 1179 bp, Homo sapiens
  misc_feature (3)..(4): n is a, c, g, or t
  misc_feature (676)..(676): n is a, c, g, or t
  misc_feature (732)..(732): n is a, c, g, or t
  misc_feature (811)..(811): n is a, c, g, or t
  misc_feature (820)..(820): n is a, c, g, or t
  misc_feature (822)..(822): n is a, c, g, or t
  misc_feature (870)..(870): n is a, c, g, or t
  misc_feature (920)..(920): n is a, c, g, or t
  misc_feature (948)..(948): n is a, c, g, or t
  misc_feature (964)..(964): n is a, c, g, or t
  misc_feature (968)..(968): n is a, c, g, or t
  misc_feature (971)..(971): n is a, c, g, or t
  misc_feature (974)..(974): n is a, c, g, or t
  misc_feature (978)..(978): n is a, c, g, or t
  misc_feature (983)..(983): n is a, c, g, or t
  misc_feature (987)..(987): n is a, c, g, or t
  misc_feature (1003)..(1003): n is a, c, g, or t
  misc_feature (1006)..(1006): n is a, c, g, or t
  misc_feature (1013)..(1013): n is a, c, g, or t
  misc_feature (1015)..(1015): n is a, c, g, or t
  misc_feature (1032)..(1032): n is a, c, g, or t
  misc_feature (1040)..(1040): n is a, c, g, or t
  misc_feature (1074)..(1074): n is a, c, g, or t
  misc_feature (1083)..(1083): n is a, c, g, or t
  misc_feature (1086)..(1087): n is a, c, g, or t
  misc_feature (1090)..(1090): n is a, c, g, or t
  misc_feature (1098)..(1098): n is a, c, g, or t
  misc_feature (1102)..(1102): n is a, c, g, or t
  misc_feature (1109)..(1109): n is a, c, g, or t
  misc_feature (1121)..(1121): n is a, c, g, or t
  misc_feature (1141)..(1141): n is a, c, g, or t
  misc_feature (1155)..(1155): n is a, c, g, or t
  misc_feature (1176)..(1176): n is a, c, g, or t
ganntagaggagaattaactatgagaggatcgcatcaccatcaccatcacggatcctatttaggtgacactatagaatcgtcgacccacgcgtccgcccacgcgatccgaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcangaaaacagcgggccagacagggatgtgcggaggggttcgaggtgttggaacaggangaattgtttctacagcattttgcctgttatacaaattatttaccctgaagttaactcgaaagcaagtgatgggtcttanaacacacananactctccatatattaaagcgcttggaattatgtaaaataaaaatatanacagcccccctaaaaaaatctggtgggaactgggtttgaaaatccttccnttgaagaatgaaaaaggaacctaaaatntgaaaggcctggttgnaagnctngtntaangaacnattnggaaaaaatgcttaanaanttttttntncaaaaaaactgggaagnggtttttntaactttgttttccaaaaaattcaaatttccaanttcaaaaanaannttngattcaanaaanttaaaanccccgaccttanaaaaaaacaaaaaaaaaaangggaaaggaaggtncttaaaaaaaaaaaacaaaanttt

SEQ ID NO: 322 - DNA, 1057 bp, Homo sapiens
  misc_feature (17)..(17): n is a, c, g, or t
  misc_feature (36)..(36): n is a, c, g, or t
  misc_feature (72)..(72): n is a, c, g, or t
  misc_feature (761)..(761): n is a, c, g, or t
  misc_feature (865)..(865): n is a, c, g, or t
  misc_feature (925)..(925): n is a, c, g, or t
  misc_feature (952)..(952): n is a, c, g, or t
  misc_feature (954)..(954): n is a, c, g, or t
  misc_feature (970)..(970): n is a, c, g, or t
  misc_feature (977)..(977): n is a, c, g, or t
  misc_feature (991)..(991): n is a, c, g, or t
  misc_feature (1002)..(1002): n is a, c, g, or t
  misc_feature (1020)..(1020): n is a, c, g, or t
  misc_feature (1023)..(1024): n is a, c, g, or t
  misc_feature (1028)..(1028): n is a, c, g, or t
  misc_feature (1038)..(1057): n is a, c, g, or t
attagagagaattactntgagaggatcgcatccccntcatccatcacggatcctatttaggtgacactatanaatcgtcgacccacgcgtccggtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacnaaaatagcaataaaacataatcactctatttgaagaaaatatcttgttttctgccaatagattttttaaaatgtagtcagcaaaatgggggtggggaagcagancatgtcctagttcaatgttgactttttttttttttttaaagaaaaagcttttaagacctnaaaatttcttttcccttttggcaaaancnttttgttttcttggtnaaaattntttttccctcctgnaggaaaaaaantacttagggaaaataaantcnngggngatgcgggannnnnnnnnnnnnnnnnnnn

SEQ ID NO: 323 - DNA, 1040 bp, Homo sapiens
  misc_feature (8)..(8): n is a, c, g, or t
  misc_feature (14)..(15): n is a, c, g, or t
  misc_feature (37)..(37): n is a, c, g, or t
  misc_feature (823)..(823): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (852)..(852): n is a, c, g, or t
  misc_feature (857)..(857): n is a, c, g, or t
  misc_feature (862)..(862): n is a, c, g, or t
  misc_feature (868)..(868): n is a, c, g, or t
  misc_feature (898)..(898): n is a, c, g, or t
  misc_feature (909)..(909): n is a, c, g, or t
  misc_feature (916)..(916): n is a, c, g, or t
  misc_feature (928)..(928): n is a, c, g, or t
  misc_feature (933)..(933): n is a, c, g, or t
  misc_feature (935)..(935): n is a, c, g, or t
  misc_feature (938)..(939): n is a, c, g, or t
  misc_feature (952)..(952): n is a, c, g, or t
  misc_feature (956)..(956): n is a, c, g, or t
  misc_feature (963)..(963): n is a, c, g, or t
  misc_feature (967)..(967): n is a, c, g, or t
  misc_feature (981)..(981): n is a, c, g, or t
  misc_feature (984)..(984): n is a, c, g, or t
  misc_feature (986)..(987): n is a, c, g, or t
  misc_feature (990)..(990): n is a, c, g, or t
  misc_feature (998)..(998): n is a, c, g, or t
  misc_feature (1002)..(1002): n is a, c, g, or t
  misc_feature (1005)..(1005): n is a, c, g, or t
  misc_feature (1017)..(1017): n is a, c, g, or t
  misc_feature (1023)..(1023): n is a, c, g, or t
  misc_feature (1032)..(1032): n is a, c, g, or t
  misc_feature (1040)..(1040): n is a, c, g, or t
atagaganaattannctatgagaggatcgcatcatcntcatccatcacggaatcctatttagggtgacactatattaatcgtcgacccacgcgtccgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccanatggcaaggatgangangangaggaggangaaanaaaangcaaanaaaggcctcatgttgcctccacccccccancaattcgaggnatgaaanggaaatccccanctggnanggnntccctcatcttcncggnggggcantttnatgtgtgacctggnacncnnacngaaaaacngaanccngggcccgggccnttcccnccccccganctgaacan

SEQ ID NO: 324 - DNA, 927 bp, Homo sapiens
tgagaggtcgcatcaccatcaccatcacggatcctatttaggtgacactatagaatcgtcgacccacgcgtccggctccgggaatgagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaagggacaacgtcagctctcctggtggggccaccatccatgccttgcatgtgctggagagtgggggcttccgctccctgctcatcaacgctgtggaggcctcctgcatccgca

SEQ ID NO: 325 - DNA, 1179 bp, Homo sapiens
  misc_feature (819)..(819): n is a, c, g, or t
  misc_feature (870)..(870): n is a, c, g, or t
  misc_feature (872)..(872): n is a, c, g, or t
  misc_feature (910)..(910): n is a, c, g, or t
  misc_feature (913)..(914): n is a, c, g, or t
  misc_feature (929)..(929): n is a, c, g, or t
  misc_feature (953)..(953): n is a, c, g, or t
  misc_feature (959)..(960): n is a, c, g, or t
  misc_feature (962)..(962): n is a, c, g, or t
  misc_feature (972)..(972): n is a, c, g, or t
  misc_feature (979)..(979): n is a, c, g, or t
  misc_feature (983)..(983): n is a, c, g, or t
  misc_feature (995)..(995): n is a, c, g, or t
  misc_feature (1004)..(1005): n is a, c, g, or t
  misc_feature (1010)..(1010): n is a, c, g, or t
  misc_feature (1018)..(1018): n is a, c, g, or t
  misc_feature (1025)..(1025): n is a, c, g, or t
  misc_feature (1038)..(1038): n is a, c, g, or t
  misc_feature (1047)..(1047): n is a, c, g, or t
  misc_feature (1060)..(1060): n is a, c, g, or t
  misc_feature (1075)..(1075): n is a, c, g, or t
  misc_feature (1080)..(1082): n is a, c, g, or t
  misc_feature (1088)..(1089): n is a, c, g, or t
  misc_feature (1101)..(1101): n is a, c, g, or t
  misc_feature (1112)..(1112): n is a, c, g, or t
  misc_feature (1117)..(1117): n is a, c, g, or t
  misc_feature (1127)..(1127): n is a, c, g, or t
  misc_feature (1137)..(1137): n is a, c, g, or t
  misc_feature (1139)..(1139): n is a, c, g, or t
  misc_feature (1141)..(1141): n is a, c, g, or t
  misc_feature (1148)..(1148): n is a, c, g, or t
  misc_feature (1152)..(1152): n is a, c, g, or t
  misc_feature (1156)..(1156): n is a, c, g, or t
  misc_feature (1159)..(1159): n is a, c, g, or t
  misc_feature (1166)..(1166): n is a, c, g, or t
  misc_feature (1169)..(1169): n is a, c, g, or t
  misc_feature (1173)..(1173): n is a, c, g, or t
  misc_feature (1176)..(1176): n is a, c, g, or t
tagagaaattactatgagaggatcgcatcaccatcaccatcacggatcctatttaggtgacactatagaatcgtcgacccacgcgtccggccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaaacanataaggcattgataggctttccttttttcccccctttttttccttttttcncntttcctcctttccttttccccccttttttcccccaaanaannaaaaattggcttttnccccttaaccaaaaatgaatttgntaaacnntngaaacacctnattcttnaaanaatggccctttntaaaacctnnaaagnaaaccccnaaatttntttttttttttgnaaaaaaaangaaaaatcccccntaccccccaaaaaanaggtnnnattttnngggccccaaaantatttttttanacccnaaaaattggnaaactcctcngngnttaaaanaaancctntgnttccccnccnccanganata

SEQ ID NO: 326 - DNA, 905 bp, Homo sapiens
  misc_feature (3)..(3): n is a, c, g, or t
  misc_feature (14)..(14): n is a, c, g, or t
  misc_feature (18)..(18): n is a, c, g, or t
  misc_feature (28)..(28): n is a, c, g, or t
  misc_feature (668)..(668): n is a, c, g, or t
  misc_feature (787)..(787): n is a, c, g, or t
  misc_feature (800)..(800): n is a, c, g, or t
  misc_feature (812)..(812): n is a, c, g, or t
  misc_feature (843)..(843): n is a, c, g, or t
  misc_feature (856)..(856): n is a, c, g, or t
  misc_feature (861)..(862): n is a, c, g, or t
  misc_feature (864)..(864): n is a, c, g, or t
  misc_feature (866)..(866): n is a, c, g, or t
  misc_feature (870)..(871): n is a, c, g, or t
  misc_feature (875)..(875): n is a, c, g, or t
  misc_feature (878)..(878): n is a, c, g, or t
  misc_feature (886)..(886): n is a, c, g, or t
  misc_feature (889)..(889): n is a, c, g, or t
  misc_feature (896)..(896): n is a, c, g, or t
  misc_feature (900)..(900): n is a, c, g, or t
ganagagagattantatnagaggatcgnatcaccagtcaccatcacggatcctatttaggtgacactatagaatcgtcgacccacgcgtccgggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacncgctgggtgagcgtgtgcggcagctgccctgcaaccacctgttccacgacggctgcatcgtgccctggctggagcagcacgacagctgccccgtctgccgaaaaagcctcacgggacanaaacacggccacnaacccccctggnctcactggggtgagctttctcctcctcgtcntcatcgtccttcntccanntngnccannaacnaanaacgccanaancaactcntgancccac

SEQ ID NO: 327 - DNA, 1126 bp, Homo sapiens
  misc_feature (3)..(3): n is a, c, g, or t
  misc_feature (13)..(13): n is a, c, g, or t
  misc_feature (881)..(881): n is a, c, g, or t
  misc_feature (915)..(915): n is a, c, g, or t
  misc_feature (919)..(919): n is a, c, g, or t
  misc_feature (947)..(947): n is a, c, g, or t
  misc_feature (952)..(952): n is a, c, g, or t
  misc_feature (969)..(969): n is a, c, g, or t
  misc_feature (973)..(973): n is a, c, g, or t
  misc_feature (975)..(975): n is a, c, g, or t
  misc_feature (982)..(982): n is a, c, g, or t
  misc_feature (984)..(984): n is a, c, g, or t
  misc_feature (986)..(986): n is a, c, g, or t
  misc_feature (989)..(989): n is a, c, g, or t
  misc_feature (999)..(999): n is a, c, g, or t
  misc_feature (1005)..(1005): n is a, c, g, or t
  misc_feature (1008)..(1008): n is a, c, g, or t
  misc_feature (1033)..(1033): n is a, c, g, or t
  misc_feature (1041)..(1042): n is a, c, g, or t
  misc_feature (1053)..(1053): n is a, c, g, or t
  misc_feature (1055)..(1055): n is a, c, g, or t
  misc_feature (1078)..(1078): n is a, c, g, or t
  misc_feature (1091)..(1091): n is a, c, g, or t
  misc_feature (1093)..(1093): n is a, c, g, or t
  misc_feature (1096)..(1096): n is a, c, g, or t
  misc_feature (1104)..(1104): n is a, c, g, or t
  misc_feature (1113)..(1113): n is a, c, g, or t
  misc_feature (1117)..(1117): n is a, c, g, or t
  misc_feature (1120)..(1121): n is a, c, g, or t
  misc_feature (1124)..(1124): n is a, c, g, or t
  misc_feature (1126)..(1126): n is a, c, g, or t
ganttagagaganttaactatgagaggatcgcatcaccatcaccagtcacgggatcctatttaggtgacactatagaatcgtcgacccacgcgtccgtgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgcccccgccccgcttcacnttgcgcatttggtactggcttttgtgatacttangaancctggcatctttttctatattatccagnggganaatctttttcacgtttnatanancaaaaananancanttactcttcntattgnaanatctgtgtttgactaagaataaaantatttttnngggaaaatttnanaaaattatattttttaaaaaaanaaatcaaaaaaancnttngggggatnggggcaagnatgnaannaanan

SEQ ID NO: 328 - DNA, 816 bp, Homo sapiens
  misc_feature (693)..(693): n is a, c, g, or t
  misc_feature (729)..(729): n is a, c, g, or t
tgagaggtcgcatcaccatcaccatcacggatcctatttaggtgacactatagaatcgtcgactctggaccttggctgtcactcagttgagcaactagagaagactttccaggaagaggaacagcatcttcagggtttggagatagcccaaggagaaaaggacctgaagcaacagctggcccaggctctgcaggaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggncagccctgctgccatcattggctgaagcaccaccangattcacggcaccccactgcttcagggtacttcgtaaactctgcctcactacatgtcgaaagagttatttgagttctcttccggttt

SEQ ID NO: 329 - DNA, 1134 bp, Homo sapiens
  misc_feature (1)..(1): n is a, c, g, or t
  misc_feature (4)..(4): n is a, c, g, or t
  misc_feature (878)..(878): n is a, c, g, or t
  misc_feature (880)..(880): n is a, c, g, or t
  misc_feature (904)..(904): n is a, c, g, or t
  misc_feature (941)..(941): n is a, c, g, or t
  misc_feature (977)..(977): n is a, c, g, or t
  misc_feature (979)..(979): n is a, c, g, or t
  misc_feature (984)..(984): n is a, c, g, or t
  misc_feature (986)..(986): n is a, c, g, or t
  misc_feature (999)..(999): n is a, c, g, or t
  misc_feature (1002)..(1002): n is a, c, g, or t
  misc_feature (1008)..(1008): n is a, c, g, or t
  misc_feature (1012)..(1012): n is a, c, g, or t
  misc_feature (1017)..(1017): n is a, c, g, or t
  misc_feature (1029)..(1029): n is a, c, g, or t
  misc_feature (1079)..(1079): n is a, c, g, or t
  misc_feature (1084)..(1084): n is a, c, g, or t
  misc_feature (1087)..(1089): n is a, c, g, or t
  misc_feature (1100)..(1102): n is a, c, g, or t
  misc_feature (1108)..(1108): n is a, c, g, or t
  misc_feature (1112)..(1112): n is a, c, g, or t
  misc_feature (1118)..(1118): n is a, c, g, or t
  misc_feature (1121)..(1121): n is a, c, g, or t
  misc_feature (1128)..(1128): n is a, c, g, or t
  misc_feature (1130)..(1130): n is a, c, g, or t
naantagagaaattactatgagaggatcgcatcaccatcaccatcacggatcctatttaggtgacactatagaatcgtcgacccacgcgtccggctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcanangcctcggcccactaaaaaacacangggagggcggatggaccaacaacccagcattgcctcntcgaagggaaggaatgacagatgaggaggccttggngncctanancaggcccagtttnccnatctcnaggnggccncagctccatcangaaaagcttcttctaagggattcccctgggacctaggaaaaacccaaggngtttnaannnagggcccccannncaatgnccancgaacnttnttgaaanangaaa

SEQ ID NO: 330 - DNA, 978 bp, Homo sapiens
taactatgagaggatcgcatcaccatcaccatcacggatcctatttaggtgacactatagaatcgtcgacccacgcgtccggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaagggccaggacagaaacgccgagaggaaccaagatgacccttgttggggcattgagaatatcatgagtgccacggggaaggggagtag

SEQ ID NO: 331 - DNA, 620 bp, Homo sapiens
  misc_feature (4)..(4): n is a, c, g, or t
  misc_feature (33)..(33): n is a, c, g, or t
  misc_feature (36)..(36): n is a, c, g, or t
  misc_feature (40)..(40): n is a, c, g, or t
  misc_feature (45)..(45): n is a, c, g, or t
aatntaaaaattatttgctttgtgagcggatanatntatngattnattgtgagcggataacaatttacacagaattattaaagaggagaaattaactatgagaggatcgcatcaccatcaccatcacggatcctatttaggtgacactatagaatcgtcgacccacgcgtccggcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtga

SEQ ID NO: 332 - DNA, 436 bp, Homo sapiens
  misc_feature (3)..(3): n is a, c, g, or t
canttagagagaattactatgagaggatcgcatcaccatcaccatcacggatcctatttaggtgacactatagaatcgtcgacccacgcgtccgggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattat

SEQ ID NO: 333 - DNA, 1112 bp, Homo sapiens
  misc_feature (809)..(809): n is a, c, g, or t
  misc_feature (811)..(811): n is a, c, g, or t
  misc_feature (819)..(819): n is a, c, g, or t
  misc_feature (852)..(852): n is a, c, g, or t
  misc_feature (863)..(863): n is a, c, g, or t
  misc_feature (908)..(908): n is a, c, g, or t
  misc_feature (912)..(912): n is a, c, g, or t
  misc_feature (925)..(925): n is a, c, g, or t
  misc_feature (945)..(945): n is a, c, g, or t
  misc_feature (953)..(953): n is a, c, g, or t
  misc_feature (955)..(955): n is a, c, g, or t
  misc_feature (963)..(963): n is a, c, g, or t
  misc_feature (968)..(968): n is a, c, g, or t
  misc_feature (980)..(980): n is a, c, g, or t
  misc_feature (984)..(984): n is a, c, g, or t
  misc_feature (988)..(988): n is a, c, g, or t
  misc_feature (990)..(990): n is a, c, g, or t
  misc_feature (993)..(993): n is a, c, g, or t
  misc_feature (999)..(999): n is a, c, g, or t
  misc_feature (1010)..(1010): n is a, c, g, or t
  misc_feature (1017)..(1017): n is a, c, g, or t
  misc_feature (1026)..(1026): n is a, c, g, or t
  misc_feature (1029)..(1029): n is a, c, g, or t
  misc_feature (1043)..(1043): n is a, c, g, or t
  misc_feature (1051)..(1052): n is a, c, g, or t
  misc_feature (1062)..(1062): n is a, c, g, or t
  misc_feature (1064)..(1064): n is a, c, g, or t
  misc_feature (1066)..(1067): n is a, c, g, or t
  misc_feature (1071)..(1072): n is a, c, g, or t
  misc_feature (1086)..(1086): n is a, c, g, or t
  misc_feature (1109)..(1110): n is a, c, g, or t
tagagaaattactatgagaggatcgcatcaccatcaccatcacggatcctatttaggtgacactatagaatcgtcgacccacgcgtccggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccanantccagganctggacggggacaccctcagcccttcataacanattccaagganagggcaccctcttgtccttatctttgccccttgtgtctgtctcanacanatctgctcctcancacgtcggtgtggggagggnattgctcntnaaccccangtggntgaccctccccncccntccngnacnttttangaaaaaaaaantgaatgnggggggttntcnttccccaaaatctnttcctttnnccaaattttncngnnaaanntttggattgcctgntttttttgggggggggtttttcnncc

SEQ ID NO: 334 - DNA, 883 bp, Homo sapiens
  misc_feature (787)..(787): n is a, c, g, or t
  misc_feature (817)..(817): n is a, c, g, or t
  misc_feature (849)..(850): n is a, c, g, or t
gatactatgagaggtcgcatcaccatcaccatcacggatcctatttaggtgacactatagaatcgtcgactctggaccttggctgtcactcagttaaaaaaaatacttcggaggacagcgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcagcggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaatttgctgcagcagaaatactgagggagagctgaaggctgggaagagaaggggagctgaactgggaagataantactgtgacatagatgtgagttaactttangaaaaggattccctttttaaaaaaatcatacnntcaaagcagcttggacagaaaaccaaagtgcct

SEQ ID NO: 335 - DNA, 1016 bp, Homo sapiens
  misc_feature (794)..(794): n is a, c, g, or t
  misc_feature (819)..(819): n is a, c, g, or t
  misc_feature (869)..(869): n is a, c, g, or t
  misc_feature (887)..(887): n is a, c, g, or t
  misc_feature (894)..(894): n is a, c, g, or t
  misc_feature (912)..(912): n is a, c, g, or t
  misc_feature (923)..(923): n is a, c, g, or t
  misc_feature (931)..(931): n is a, c, g, or t
  misc_feature (937)..(937): n is a, c, g, or t
  misc_feature (943)..(943): n is a, c, g, or t
  misc_feature (949)..(949): n is a, c, g, or t
  misc_feature (951)..(951): n is a, c, g, or t
  misc_feature (971)..(971): n is a, c, g, or t
  misc_feature (979)..(979): n is a, c, g, or t
  misc_feature (982)..(982): n is a, c, g, or t
  misc_feature (989)..(990): n is a, c, g, or t
  misc_feature (992)..(992): n is a, c, g, or t
  misc_feature (994)..(994): n is a, c, g, or t
  misc_feature (996)..(996): n is a, c, g, or t
  misc_feature (1008)..(1008): n is a, c, g, or t
  misc_feature (1011)..(1012): n is a, c, g, or t
  misc_feature (1016)..(1016): n is a, c, g, or t
tagagaaattactatgagaggatcgcatcaccatcaccatcacggatcctatttaggtgacactatagaatcgtcgacccacgcgtccgcctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactangcccccacttgcctcttccttgaanaattgcaggccctggcctcccctgccaccaggccacctccccagcattcnagcccttctggtcgctcntgcccanggaaatcttggggtgtgntggaactccantctgcttntctganttttgnctggananttaagggcaccaggggtttntcgcatangancttttcnncnananccagaacctggnatnncaan

SEQ ID NO: 336 - DNA, 634 bp, Homo sapiens
  misc_feature (5)..(5): n is a, c, g, or t
tcganaatataaaaaattatttgctttgtgagcggatacaatataatagattaattgtgagcggataacaatttacacagaattcattaaagaggagaaattaactatgagaggatcgcatcaccatcaccatcacggatcctatttaggtgacactatagaatcgtcgacccacgcgtccggtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactat

SEQ ID NO: 337 - DNA, 1027 bp, Homo sapiens
  misc_feature (3)..(3): n is a, c, g, or t
  misc_feature (740)..(740): n is a, c, g, or t
  misc_feature (788)..(788): n is a, c, g, or t
  misc_feature (799)..(799): n is a, c, g, or t
  misc_feature (801)..(801): n is a, c, g, or t
  misc_feature (803)..(803): n is a, c, g, or t
  misc_feature (823)..(823): n is a, c, g, or t
  misc_feature (849)..(849): n is a, c, g, or t
  misc_feature (870)..(870): n is a, c, g, or t
  misc_feature (890)..(890): n is a, c, g, or t
  misc_feature (892)..(892): n is a, c, g, or t
  misc_feature (907)..(907): n is a, c, g, or t
  misc_feature (913)..(913): n is a, c, g, or t
  misc_feature (925)..(925): n is a, c, g, or t
  misc_feature (927)..(927): n is a, c, g, or t
  misc_feature (929)..(929): n is a, c, g, or t
  misc_feature (932)..(933): n is a, c, g, or t
  misc_feature (935)..(935): n is a, c, g, or t
  misc_feature (944)..(944): n is a, c, g, or t
  misc_feature (950)..(950): n is a, c, g, or t
  misc_feature (961)..(962): n is a, c, g, or t
  misc_feature (970)..(970): n is a, c, g, or t
  misc_feature (983)..(983): n is a, c, g, or t
  misc_feature (997)..(998): n is a, c, g, or t
  misc_feature (1007)..(1007): n is a, c, g, or t
  misc_feature (1010)..(1010): n is a, c, g, or t
  misc_feature (1016)..(1016): n is a, c, g, or t
  misc_feature (1023)..(1024): n is a, c, g, or t
cantagagagaattactatgagaggatcgcatcaccatcaccatcacggatcctatttaggtgacactatagaatcgtcgacccacgcgtccggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggcgctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaangaagccttctggttgtctgccacttcctcctgttggactgcctgaaanaggggaaaaanananacctcggacctgcatgtcangatggattttccccttttatctctgncctcctccactccctttttgnaactcccttacagcccccanancctttttgaaacganagccancaagctgaacananancannancgacttccnttccancccccaaaaanntcggtcanttgagtgttttcnaaaatcctgggggnnttcccgggnccncttttnaaaaaannggg

SEQ ID NO: 338 - DNA, 1270 bp, Homo sapiens
  misc_feature (890)..(890): n is a, c, g, or t
  misc_feature (934)..(934): n is a, c, g, or t
  misc_feature (949)..(949): n is a, c, g, or t
  misc_feature (966)..(966): n is a, c, g, or t
  misc_feature (984)..(984): n is a, c, g, or t
  misc_feature (986)..(986): n is a, c, g, or t
  misc_feature (992)..(992): n is a, c, g, or t
  misc_feature (1000)..(1000): n is a, c, g, or t
  misc_feature (1019)..(1019): n is a, c, g, or t
  misc_feature (1022)..(1022): n is a, c, g, or t
  misc_feature (1050)..(1050): n is a, c, g, or t
  misc_feature (1064)..(1065): n is a, c, g, or t
  misc_feature (1102)..(1102): n is a, c, g, or t
  misc_feature (1112)..(1112): n is a, c, g, or t
  misc_feature (1117)..(1117): n is a, c, g, or t
  misc_feature (1125)..(1125): n is a, c, g, or t
  misc_feature (1133)..(1133): n is a, c, g, or t
  misc_feature (1143)..(1143): n is a, c, g, or t
  misc_feature (1145)..(1145): n is a, c, g, or t
  misc_feature (1149)..(1149): n is a, c, g, or t
  misc_feature (1156)..(1156): n is a, c, g, or t
  misc_feature (1159)..(1159): n is a, c, g, or t
  misc_feature (1185)..(1185): n is a, c, g, or t
  misc_feature (1191)..(1191): n is a, c, g, or t
  misc_feature (1204)..(1204): n is a, c, g, or t
  misc_feature (1218)..(1218): n is a, c, g, or t
  misc_feature (1220)..(1222): n is a, c, g, or t
  misc_feature (1227)..(1229): n is a, c, g, or t
  misc_feature (1237)..(1237): n is a, c, g, or t
  misc_feature (1239)..(1239): n is a, c, g, or t
  misc_feature (1242)..(1243): n is a, c, g, or t
  misc_feature (1252)..(1252): n is a, c, g, or t
  misc_feature (1258)..(1258): n is a, c, g, or t
  misc_feature (1261)..(1261): n is a, c, g, or t
tagagaaattactatgagaggatcgcatcaccatcaccatcacggatcctatttaggtgacactatagaatcgtcgacccacgcgtccggcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaatctccagatgcagatgatgattctgtagccaaaagcangccaggagtccaagaggggattcaggttcttggaagcctgtcancctccaccgggctanaccaagcaaaaatgaanattctgataaatcttacncngttatngggaaagnaatctcaaaaatgtctgcnccnagaaaaaactgtccttggaatcccggantgctcaggctcccnnaaaaaattttaaaaaatccccctggaaaaaagggaanctgaaattancccgnctgaaaanctgatgcnaaggtcctgnanggantcgaacnaanctccaaaactttaagaccccaaaaanccccgngggaaggtgaccnaccaggcccccccntnnnaaaannnaaaaaatngnacnnccaaaaccngcccgnaanaaaaacccc

SEQ ID NO: 339 - DNA, 1087 bp, Homo sapiens
  misc_feature (917)..(917): n is a, c, g, or t
  misc_feature (934)..(934): n is a, c, g, or t
  misc_feature (953)..(953): n is a, c, g, or t
  misc_feature (960)..(960): n is a, c, g, or t
  misc_feature (982)..(982): n is a, c, g, or t
  misc_feature (992)..(992): n is a, c, g, or t
  misc_feature (1027)..(1027): n is a, c, g, or t
  misc_feature (1031)..(1031): n is a, c, g, or t
  misc_feature (1043)..(1043): n is a, c, g, or t
  misc_feature (1049)..(1049): n is a, c, g, or t
  misc_feature (1064)..(1064): n is a, c, g, or t
  misc_feature (1087)..(1087): n is a, c, g, or t
tagagaaattactatgagaggatcgcatcaccatcaccatcacggatcctatttaggtgacactatagaatcgtcgacccacgcgtccgcccacgcgtccgcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggaaagacaaggctgctgctattagagcccatcctggagccccacctctgaaccacctcctaccagctgtccctcaggctgggggaaancaggtgttgatttgtcnccgttggagcttggatatntgcctgncatgtgtgtgtgtgtgtgaaantgtgaatgcncaggtgggtatttatctgtattattccccgttctngganttttcttccccntggggnctggggtactttacnttcaataaatactgtttaacccn

SEQ ID NO: 340 - DNA, 1147 bp, Homo sapiens
  misc_feature (1)..(1): n is a, c, g, or t
  misc_feature (11)..(11): n is a, c, g, or t
  misc_feature (769)..(769): n is a, c, g, or t
  misc_feature (794)..(794): n is a, c, g, or t
  misc_feature (804)..(804): n is a, c, g, or t
  misc_feature (836)..(836): n is a, c, g, or t
  misc_feature (840)..(840): n is a, c, g, or t
  misc_feature (849)..(849): n is a, c, g, or t
  misc_feature (860)..(860): n is a, c, g, or t
  misc_feature (862)..(862): n is a, c, g, or t
  misc_feature (877)..(878): n is a, c, g, or t
  misc_feature (883)..(883): n is a, c, g, or t
  misc_feature (896)..(896): n is a, c, g, or t
  misc_feature (917)..(917): n is a, c, g, or t
  misc_feature (951)..(951): n is a, c, g, or t
  misc_feature (963)..(963): n is a, c, g, or t
  misc_feature (965)..(965): n is a, c, g, or t
  misc_feature (969)..(969): n is a, c, g, or t
  misc_feature (971)..(971): n is a, c, g, or t
  misc_feature (984)..(984): n is a, c, g, or t
  misc_feature (991)..(991): n is a, c, g, or t
  misc_feature (998)..(998): n is a, c, g, or t
  misc_feature (1015)..(1015): n is a, c, g, or t
  misc_feature (1023)..(1023): n is a, c, g, or t
  misc_feature (1025)..(1025): n is a, c, g, or t
  misc_feature (1032)..(1032): n is a, c, g, or t
  misc_feature (1036)..(1037): n is a, c, g, or t
  misc_feature (1040)..(1040): n is a, c, g, or t
  misc_feature (1048)..(1048): n is a, c, g, or t
  misc_feature (1052)..(1052): n is a, c, g, or t
  misc_feature (1059)..(1059): n is a, c, g, or t
  misc_feature (1063)..(1063): n is a, c, g, or t
  misc_feature (1065)..(1065): n is a, c, g, or t
  misc_feature (1071)..(1073): n is a, c, g, or t
  misc_feature (1081)..(1081): n is a, c, g, or t
  misc_feature (1089)..(1090): n is a, c, g, or t
  misc_feature (1102)..(1102): n is a, c, g, or t
  misc_feature (1105)..(1105): n is a, c, g, or t
  misc_feature (1110)..(1110): n is a, c, g, or t
  misc_feature (1146)..(1146): n is a, c, g, or t
naaatagaganattactatgagaggatcgcatcaccatcaccatcacggatcctatttaggtgacactatagaatcgtcgacccacgcgtccgattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgcccccacctccccagggtccaacagacaagtcatgcacaatgtaaaaaccagcccaagcaaggncataaagggaggtgacttaaaaaanaaaatggatnagtgacaaaagtcactgatccataactttccntaanttttgggcntataactgganancttttggcttttttnngttgnccaaaggtaatgnctgaaaataacttaatttaancgggcattggattttgaaatttttttaaaaaaangggaaaattgtncntttnangacaataaaaaancttaaanttatttnaaaatccaatggtggcncccttgtnanagaaagnaaannccnctttcccnattntaaaaancttncngttttnnnttaccccnctttaatnnaaaaggttgganctnaaggnaaaaaaaccccaaaggccccccccctttggaaaaanc

SEQ ID NO: 341 - DNA, 1238 bp, Homo sapiens
  misc_feature (1)..(1): n is a, c, g, or t
  misc_feature (799)..(799): n is a, c, g, or t
  misc_feature (873)..(873): n is a, c, g, or t
  misc_feature (922)..(922): n is a, c, g, or t
  misc_feature (939)..(939): n is a, c, g, or t
  misc_feature (969)..(969): n is a, c, g, or t
  misc_feature (1007)..(1007): n is a, c, g, or t
  misc_feature (1011)..(1011): n is a, c, g, or t
  misc_feature (1017)..(1017): n is a, c, g, or t
  misc_feature (1030)..(1030): n is a, c, g, or t
  misc_feature (1049)..(1049): n is a, c, g, or t
  misc_feature (1063)..(1064): n is a, c, g, or t
  misc_feature (1066)..(1066): n is a, c, g, or t
  misc_feature (1080)..(1080): n is a, c, g, or t
  misc_feature (1083)..(1084): n is a, c, g, or t
  misc_feature (1093)..(1093): n is a, c, g, or t
  misc_feature (1100)..(1100): n is a, c, g, or t
  misc_feature (1104)..(1105): n is a, c, g, or t
  misc_feature (1121)..(1121): n is a, c, g, or t
  misc_feature (1130)..(1131): n is a, c, g, or t
  misc_feature (1134)..(1134): n is a, c, g, or t
  misc_feature (1144)..(1144): n is a, c, g, or t
  misc_feature (1171)..(1171): n is a, c, g, or t
  misc_feature (1179)..(1179): n is a, c, g, or t
  misc_feature (1183)..(1183): n is a, c, g, or t
  misc_feature (1189)..(1189): n is a, c, g, or t
  misc_feature (1193)..(1193): n is a, c, g, or t
  misc_feature (1195)..(1195): n is a, c, g, or t
  misc_feature (1219)..(1219): n is a, c, g, or t
  misc_feature (1223)..(1223): n is a, c, g, or t
  misc_feature (1235)..(1235): n is a, c, g, or t
naatagagaaattactatgagaggatcgcatcaccatcaccatcacggatcctatttaggtgacactatagaatcgtcgacccacgcgtccggtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaantcatctgttctacctctttatgaaaatacttttcaggagctccaggtaatgaggcggagcctgaatttgtttanaacacaaatgatggatttagaattggcaatgctgcgtcagccaaaccanggtttatcatcatatgnactgaggaggagaggtttgaagttgatcanctcccagggtttgaaaaattcagtccgaatggaacttncagnacctgnaactgcacctggnagaaccccctgctgggccntgaaaaaaaacttnngnggtgggggaaggcnttnnccctttcgnctcctcngaannctggggaaaggggggncaaaaaaannctnaaactggccngcccttccccttgaaggaaggaacccntccctganttgngcggancccntnacctgaatcttaatgggccggganttgnaaaaagggattnaaa

SEQ ID NO: 342 - DNA, 1154 bp, Homo sapiens
  misc_feature (878)..(878): n is a, c, g, or t
  misc_feature (902)..(902): n is a, c, g, or t
  misc_feature (907)..(907): n is a, c, g, or t
  misc_feature (925)..(925): n is a, c, g, or t
  misc_feature (983)..(983): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1012)..(1012): n is a, c, g, or t
  misc_feature (1021)..(1021): n is a, c, g, or t
  misc_feature (1033)..(1033): n is a, c, g, or t
  misc_feature (1036)..(1036): n is a, c, g, or t
  misc_feature (1038)..(1038): n is a, c, g, or t
  misc_feature (1047)..(1047): n is a, c, g, or t
  misc_feature (1062)..(1062): n is a, c, g, or t
  misc_feature (1064)..(1064): n is a, c, g, or t
  misc_feature (1071)..(1071): n is a, c, g, or t
  misc_feature (1073)..(1073): n is a, c, g, or t
  misc_feature (1087)..(1087): n is a, c, g, or t
  misc_feature (1093)..(1093): n is a, c, g, or t
  misc_feature (1097)..(1097): n is a, c, g, or t
  misc_feature (1104)..(1104): n is a, c, g, or t
  misc_feature (1118)..(1118): n is a, c, g, or t
  misc_feature (1125)..(1125): n is a, c, g, or t
  misc_feature (1133)..(1154): n is a, c, g, or t
tagagaaaattaactatgagaggatcgcatcaccatcaccatcacggatcctatttaggtgacactatagaatcgtcgacccacgcgtccgctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggcccnaggggcagcaaggccttggtggancagcnagagctgtgcctgctcancagccagtctcaaaaaacaagcactcagcctcattcagcatgggttccttgatgccanaaggncnagcagnctcctggctgtgccancaggcccancatgcagggggnggnanactgggcancaaggctgctgccgnantccttcncnatcagggttggggnataacnttgnaaaattnggaagggggagggnaggaaantttttttnnnnnnnnnnnnnnnnnnnnnn

SEQ ID NO: 343 - DNA, 1374 bp, Homo sapiens
  misc_feature (6)..(7): n is a, c, g, or t
  misc_feature (1154)..(1154): n is a, c, g, or t
  misc_feature (1344)..(1344): n is a, c, g, or t
tttaannggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgcccacgcgtccgaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaaagtattaaacgtgtcaagtaatcagcaggatttgccttcctggtcttctgctgatgaactggacacctcagggcctgggagtcccactttcaggaaagacaccccaaacagaacaaaaaccccccgagggcaggggaatctctcccacctggaaccctcggcaacaatccccctatcaggtcccaaaaaggtggcccccaatccccctttcgaaaccagagccagtccgacccaacccaaatccaatcaaattcaatcacataaattaatttcctgcgaaaaaacaatatacaatcaaaacttcctactaatttaatacaacgctcgattcacaccgatataattttcagaaacaataaaccccaaacgctaaaacaaataaccaataaaacaccgtatatcaaatcttcctattccanctacactaatcatacactccattaaccccttctaacaaatcattttatataccatcacaactcaatcaccaacctataacgatattaattcaatacacaataaaaaataccacataattacaatataacaccaattcagttaagcccatccaaccatcacacccaagattctcacccctacgactaatanaaatcgcgaatcagaactaagcaaaacaca

SEQ ID NO: 344 - DNA, 814 bp, Homo sapiens
  misc_feature (2)..(2): n is a, c, g, or t
  misc_feature (4)..(4): n is a, c, g, or t
  misc_feature (9)..(10): n is a, c, g, or t
tnanagggnnaattaactatgagaggatcgcatcaccatcaccatcacggatcctatttaggtgacactatagaatcgtcgacccacgcgtccgtaaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatc

SEQ ID NO: 345 - DNA, 488 bp, Homo sapiens
tatgagaggtcgcatcaccatcaccatcacggatcctatttaggtgacactatagaatcgtcgacccacgcgtccgggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgagga

SEQ ID NO: 346 - DNA, 1127 bp, Homo sapiens
  misc_feature (873)..(873): n is a, c, g, or t
  misc_feature (902)..(902): n is a, c, g, or t
  misc_feature (911)..(911): n is a, c, g, or t
  misc_feature (914)..(914): n is a, c, g, or t
  misc_feature (918)..(918): n is a, c, g, or t
  misc_feature (926)..(926): n is a, c, g, or t
  misc_feature (937)..(937): n is a, c, g, or t
  misc_feature (949)..(949): n is a, c, g, or t
  misc_feature (954)..(954): n is a, c, g, or t
  misc_feature (979)..(979): n is a, c, g, or t
  misc_feature (981)..(981): n is a, c, g, or t
  misc_feature (997)..(997): n is a, c, g, or t
  misc_feature (1016)..(1016): n is a, c, g, or t
  misc_feature (1020)..(1020): n is a, c, g, or t
  misc_feature (1023)..(1023): n is a, c, g, or t
  misc_feature (1035)..(1035): n is a, c, g, or t
  misc_feature (1041)..(1041): n is a, c, g, or t
  misc_feature (1048)..(1048): n is a, c, g, or t
  misc_feature (1051)..(1051): n is a, c, g, or t
  misc_feature (1054)..(1054): n is a, c, g, or t
  misc_feature (1062)..(1062): n is a, c, g, or t
  misc_feature (1067)..(1067): n is a, c, g, or t
  misc_feature (1071)..(1071): n is a, c, g, or t
  misc_feature (1075)..(1075): n is a, c, g, or t
  misc_feature (1083)..(1083): n is a, c, g, or t
  misc_feature (1094)..(1094): n is a, c, g, or t
  misc_feature (1098)..(1099): n is a, c, g, or t
  misc_feature (1107)..(1107): n is a, c, g, or t
  misc_feature (1110)..(1110): n is a, c, g, or t
  misc_feature (1113)..(1113): n is a, c, g, or t
  misc_feature (1115)..(1116): n is a, c, g, or t
  misc_feature (1121)..(1121): n is a, c, g, or t
  misc_feature (1123)..(1125): n is a, c, g, or t
agagaattactatgagaggatcgcatcaccatcaccatcacggatcctatttaggtgacactatagaatcgtcgacccacgcgtccgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccagntcaaaggaggggccctgcccccagccaanagggccaanaanccanaaaaggantcaaaaagtantgaggagggatntgaantgaggaggaggcccttgcagggacncnaaaccaggtaaaggcntctgaaaaattttcaggtnaaantgnctcacccctgcnaggganccctggnaanggntacccacnccccntggnaggnagggctgnaccttccaacnaggnnggaacccnagngantnnaaacncnnnag

SEQ ID NO: 347 - DNA, 1131 bp, Homo sapiens
  misc_feature (788)..(788): n is a, c, g, or t
  misc_feature (808)..(808): n is a, c, g, or t
  misc_feature (834)..(834): n is a, c, g, or t
  misc_feature (869)..(869): n is a, c, g, or t
  misc_feature (880)..(880): n is a, c, g, or t
  misc_feature (882)..(882): n is a, c, g, or t
  misc_feature (890)..(890): n is a, c, g, or t
  misc_feature (897)..(897): n is a, c, g, or t
  misc_feature (908)..(908): n is a, c, g, or t
  misc_feature (928)..(928): n is a, c, g, or t
  misc_feature (932)..(932): n is a, c, g, or t
  misc_feature (942)..(943): n is a, c, g, or t
  misc_feature (952)..(952): n is a, c, g, or t
  misc_feature (958)..(958): n is a, c, g, or t
  misc_feature (964)..(964): n is a, c, g, or t
  misc_feature (967)..(967): n is a, c, g, or t
  misc_feature (969)..(969): n is a, c, g, or t
  misc_feature (977)..(977): n is a, c, g, or t
  misc_feature (982)..(982): n is a, c, g, or t
  misc_feature (987)..(987): n is a, c, g, or t
  misc_feature (1012)..(1012): n is a, c, g, or t
  misc_feature (1014)..(1014): n is a, c, g, or t
  misc_feature (1016)..(1016): n is a, c, g, or t
  misc_feature (1034)..(1034): n is a, c, g, or t
  misc_feature (1048)..(1048): n is a, c, g, or t
  misc_feature (1050)..(1050): n is a, c, g, or t
  misc_feature (1055)..(1055): n is a, c, g, or t
  misc_feature (1065)..(1065): n is a, c, g, or t
  misc_feature (1074)..(1074): n is a, c, g, or t
  misc_feature (1079)..(1079): n is a, c, g, or t
  misc_feature (1081)..(1081): n is a, c, g, or t
  misc_feature (1083)..(1083): n is a, c, g, or t
  misc_feature (1097)..(1098): n is a, c, g, or t
  misc_feature (1104)..(1104): n is a, c, g, or t
  misc_feature (1106)..(1107): n is a, c, g, or t
  misc_feature (1109)..(1109): n is a, c, g, or t
  misc_feature (1121)..(1121): n is a, c, g, or t
  misc_feature (1129)..(1129): n is a, c, g, or t
aatagagaaattaactatgagaggatcgcatcaccatcaccatcacggatcctatttaggtgacactatagaatcgtcgacccacgcgtccggcacctcctcccgtcaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaanctttgaaaaagaaaaagaanatgccaaagcttcgctttgccagtanaatccggaaaattcggaaaaaagcaattttaaaanattcttaatangncatcttgntttggcntttatggcctnatttgccctttaagggttgnaacngaaaaataannatgaaagcntgaagnaaaacnaantntttggggnatttntttcncccagtttttttattaataacaagncncntttttaaaaaaatttggnaattttttttaaananaaaanaacctgctantcaaaatgngaaancnanccatttttaaattnnggttcnanntnttttgggaaaantaaatttntt

SEQ ID NO: 348 - DNA, 1179 bp, Homo sapiens
  misc_feature (1)..(1): n is a, c, g, or t
  misc_feature (883)..(883): n is a, c, g, or t
  misc_feature (915)..(915): n is a, c, g, or t
  misc_feature (944)..(944): n is a, c, g, or t
  misc_feature (946)..(946): n is a, c, g, or t
  misc_feature (950)..(950): n is a, c, g, or t
  misc_feature (967)..(967): n is a, c, g, or t
  misc_feature (975)..(975): n is a, c, g, or t
  misc_feature (987)..(988): n is a, c, g, or t
  misc_feature (1000)..(1000): n is a, c, g, or t
  misc_feature (1012)..(1012): n is a, c, g, or t
  misc_feature (1015)..(1015): n is a, c, g, or t
  misc_feature (1032)..(1032): n is a, c, g, or t
  misc_feature (1037)..(1040): n is a, c, g, or t
  misc_feature (1051)..(1051): n is a, c, g, or t
  misc_feature (1054)..(1055): n is a, c, g, or t
  misc_feature (1058)..(1058): n is a, c, g, or t
  misc_feature (1067)..(1067): n is a, c, g, or t
  misc_feature (1079)..(1079): n is a, c, g, or t
  misc_feature (1093)..(1093): n is a, c, g, or t
  misc_feature (1102)..(1102): n is a, c, g, or t
  misc_feature (1104)..(1104): n is a, c, g, or t
  misc_feature (1133)..(1133): n is a, c, g, or t
  misc_feature (1158)..(1158): n is a, c, g, or t
  misc_feature (1160)..(1160): n is a, c, g, or t
  misc_feature (1162)..(1162): n is a, c, g, or t
  misc_feature (1166)..(1166): n is a, c, g, or t
  misc_feature (1170)..(1170): n is a, c, g, or t
  misc_feature (1176)..(1176): n is a, c, g, or t
naaaagagaaattactatgagaggatcgcatcaccatcaccatcacggatcctatttaggtgacactatagaatcgtcgacccacgcgtccggcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgtcgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaanaatcaaaactggaagcaaaaaacttgcttgantttttttttcttgttaacgtaataaaaananaaantttttaaaagcccacanctcaaagncagcccaaaaannccttttccctantttgggactttnacnaaaaaaaaaaaaaatcntgccnnnnaaattatcttngannccntttacctgnaaaaagcccctnctttttttcccccnaaaattttnancttgactttcaaaaaaaattttccggggnttttgggggggggtggttttttggntngnttgntttngggggnaaa

SEQ ID NO: 349 - DNA, 1007 bp, Homo sapiens
  misc_feature (788)..(788): n is a, c, g, or t
  misc_feature (800)..(800): n is a, c, g, or t
  misc_feature (832)..(832): n is a, c, g, or t
  misc_feature (839)..(839): n is a, c, g, or t
  misc_feature (854)..(854): n is a, c, g, or t
  misc_feature (856)..(856): n is a, c, g, or t
  misc_feature (875)..(875): n is a, c, g, or t
  misc_feature (877)..(877): n is a, c, g, or t
  misc_feature (880)..(880): n is a, c, g, or t
  misc_feature (885)..(885): n is a, c, g, or t
  misc_feature (888)..(888): n is a, c, g, or t
  misc_feature (891)..(891): n is a, c, g, or t
  misc_feature (896)..(896): n is a, c, g, or t
  misc_feature (902)..(902): n is a, c, g, or t
  misc_feature (905)..(906): n is a, c, g, or t
  misc_feature (908)..(908): n is a, c, g, or t
  misc_feature (920)..(920): n is a, c, g, or t
  misc_feature (930)..(930): n is a, c, g, or t
  misc_feature (942)..(943): n is a, c, g, or t
  misc_feature (953)..(953): n is a, c, g, or t
  misc_feature (957)..(957): n is a, c, g, or t
  misc_feature (960)..(960): n is a, c, g, or t
  misc_feature (963)..(964): n is a, c, g, or t
  misc_feature (981)..(981): n is a, c, g, or t
  misc_feature (990)..(990): n is a, c, g, or t
  misc_feature (998)..(998): n is a, c, g, or t
  misc_feature (1000)..(1000): n is a, c, g, or t
tagagaaattactatgagaggatcgcatcaccatcaccatcacggatcctatttaggtgacactatagaatcgtcgacccacgcgtccgcccacgcgtccgtagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcancctacccagcancctacagcctggttgcacctgcgttcccgcancctccanccctggtcgcccaanancccccaccaccacctcaanancancacancancancacancaacancannancacaaaaaaaangcctgatggntgcaaatctttnnttacacttgnccanganttnntgaatcaaaatcctccnaagtttgtnccctttgncncgtcatt

SEQ ID NO: 350 - DNA, 615 bp, Homo sapiens
tagagaaattaactatgagaggatcgcatcaccatcaccatcacggatcctatttaggtgacactatagaatcgtcgacccacgcgtccgcccacgcgtccggtctttgtgtgtgtatgtgtgatctctgcctgcaggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttc

SEQ ID NO: 351 - DNA, 716 bp, Homo sapiens
  misc_feature (2)..(2): n is a, c, g, or t
  misc_feature (383)..(383): n is a, c, g, or t
  misc_feature (426)..(426): n is a, c, g, or t
  misc_feature (437)..(437): n is a, c, g, or t
  misc_feature (458)..(458): n is a, c, g, or t
  misc_feature (466)..(466): n is a, c, g, or t
  misc_feature (470)..(470): n is a, c, g, or t
  misc_feature (501)..(501): n is a, c, g, or t
  misc_feature (529)..(529): n is a, c, g, or t
  misc_feature (541)..(541): n is a, c, g, or t
  misc_feature (547)..(547): n is a, c, g, or t
  misc_feature (565)..(565): n is a, c, g, or t
  misc_feature (571)..(571): n is a, c, g, or t
  misc_feature (577)..(577): n is a, c, g, or t
  misc_feature (584)..(584): n is a, c, g, or t
  misc_feature (588)..(588): n is a, c, g, or t
  misc_feature (591)..(591): n is a, c, g, or t
  misc_feature (594)..(595): n is a, c, g, or t
  misc_feature (598)..(598): n is a, c, g, or t
  misc_feature (600)..(600): n is a, c, g, or t
  misc_feature (611)..(611): n is a, c, g, or t
  misc_feature (622)..(622): n is a, c, g, or t
  misc_feature (624)..(624): n is a, c, g, or t
  misc_feature (626)..(626): n is a, c, g, or t
  misc_feature (639)..(639): n is a, c, g, or t
  misc_feature (652)..(652): n is a, c, g, or t
  misc_feature (660)..(660): n is a, c, g, or t
  misc_feature (663)..(663): n is a, c, g, or t
  misc_feature (665)..(665): n is a, c, g, or t
  misc_feature (668)..(668): n is a, c, g, or t
  misc_feature (685)..(685): n is a, c, g, or t
  misc_feature (689)..(689): n is a, c, g, or t
  misc_feature (699)..(699): n is a, c, g, or t
  misc_feature (702)..(702): n is a, c, g, or t
  misc_feature (709)..(709): n is a, c, g, or t
antagagagaattactatgagaggatcgcatcaccatcaccatcacggatcctatttaggtgacactatagaatcgtcgacccacgcgtccgcccacgcgtccgctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccganaccacccccccgtgctggtctcctctgcagcctcgagccaggnagaggcagatnagatgtcagagtgaaagcaanagcagtancaanatctccaccatgttggtgacacacgattacncggccagtgaaggaggatgatatcaacntctaccaagganaggtcnttcaaattctggccagcnaaccancataanatgtttntggngtntcnnagncnccactgaccantgccccgcaantnanggctggattccangctttgtcctggnccaaccantgnantcntcgtgaagaacccgganttgnactcttcagnaantccactntcttggc

SEQ ID NO: 352 - DNA, 816 bp, Homo sapiens
agaggatcgcatcaccatcaccatcacggatcctatttaggtgacactatagaatcgtcgacccacgcgtccgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcc

SEQ ID NO: 353 - DNA, 866 bp, Homo sapiens
  misc_feature (4)..(4): n is a, c, g, or t
aatngagaaattactatgagaggatcgcatcaccatcaccatcacggatcctatttaggtgacactatagaatcgtcgacccacgcgtccgctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtag

SEQ ID NO: 354 - DNA, 1227 bp, Homo sapiens
  misc_feature (902)..(902): n is a, c, g, or t
  misc_feature (971)..(971): n is a, c, g, or t
  misc_feature (995)..(995): n is a, c, g, or t
  misc_feature (1020)..(1020): n is a, c, g, or t
  misc_feature (1023)..(1023): n is a, c, g, or t
  misc_feature (1027)..(1027): n is a, c, g, or t
  misc_feature (1030)..(1030): n is a, c, g, or t
  misc_feature (1033)..(1034): n is a, c, g, or t
  misc_feature (1047)..(1047): n is a, c, g, or t
  misc_feature (1050)..(1050): n is a, c, g, or t
  misc_feature (1063)..(1063): n is a, c, g, or t
  misc_feature (1069)..(1069): n is a, c, g, or t
  misc_feature (1073)..(1073): n is a, c, g, or t
  misc_feature (1078)..(1078): n is a, c, g, or t
  misc_feature (1092)..(1093): n is a, c, g, or t
  misc_feature (1104)..(1104): n is a, c, g, or t
  misc_feature (1149)..(1149): n is a, c, g, or t
  misc_feature (1151)..(1151): n is a, c, g, or t
  misc_feature (1172)..(1172): n is a, c, g, or t
  misc_feature (1178)..(1178): n is a, c, g, or t
  misc_feature (1180)..(1180): n is a, c, g, or t
  misc_feature (1186)..(1186): n is a, c, g, or t
  misc_feature (1193)..(1196): n is a, c, g, or t
  misc_feature (1208)..(1208): n is a, c, g, or t
  misc_feature (1216)..(1216): n is a, c, g, or t
  misc_feature (1219)..(1219): n is a, c, g, or t
  misc_feature (1222)..(1222): n is a, c, g, or t
tagaggaaaattactatgagaggatcgcatcaccatcaccatcacggatcctatttaggtgacactatagaatcgtcgacccacgcgtccggtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggacctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcncggaaaggagcacaaagatgctactcaggcaagagaagggccttctcgggaaacttctcccccgggaanccctgcatctggctgggcagcccntaggtttttccctacaaaagtaagnggncccntanaannttctcttcccccnacntgtcctggaaaantacaangttnttttnaaatacttactganngggccccgggngcaaacttaacttgcacccttgctgggccctaaaatggcgggcangnccctcagtcaaaccaaatggngattcnangggccnaaaaaannnnggattttggggnaaacctcnaanatncccgg

SEQ ID NO: 355 - DNA, 875 bp, Homo sapiens
  misc_feature (856)..(856): n is a, c, g, or t
  misc_feature (863)..(864): n is a, c, g, or t
gagatactatgagaggtcgcatcccatcaccatcacggatcctatttaggtgacactatagaatcgtcgactctggaccttggctgtcactcagttaagaaggcgaatgcaatgctggacgaggacgaggatgagcgtgtggacgaggctgccctgcggcagctcacggggatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccaaaaacattgctagcatttgaagacatgctggagaacccactgaacagcacccagtggatgaatgatccagaaacggggcctgtcatgctgcagatctctagaatcttccagacactaaatcgcacgtaggtggcgtcgttccactcggctatcaggccacagcagccccctggtgcggcccgagaccgggcagagtggaccntcactgnnaaactcacttc

SEQ ID NO: 356 - DNA, 553 bp, Homo sapiens
  misc_feature (261)..(261): n is a, c, g, or t
  misc_feature (276)..(276): n is a, c, g, or t
  misc_feature (286)..(286): n is a, c, g, or t
  misc_feature (289)..(289): n is a, c, g, or t
  misc_feature (302)..(302): n is a, c, g, or t
  misc_feature (314)..(314): n is a, c, g, or t
  misc_feature (316)..(316): n is a, c, g, or t
  misc_feature (327)..(327): n is a, c, g, or t
  misc_feature (332)..(332): n is a, c, g, or t
  misc_feature (338)..(338): n is a, c, g, or t
  misc_feature (356)..(356): n is a, c, g, or t
  misc_feature (370)..(370): n is a, c, g, or t
  misc_feature (372)..(372): n is a, c, g, or t
  misc_feature (381)..(381): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (407)..(407): n is a, c, g, or t
  misc_feature (428)..(428): n is a, c, g, or t
  misc_feature (432)..(432): n is a, c, g, or t
  misc_feature (435)..(435): n is a, c, g, or t
  misc_feature (442)..(442): n is a, c, g, or t
  misc_feature (464)..(464): n is a, c, g, or t
  misc_feature (471)..(471): n is a, c, g, or t
  misc_feature (491)..(493): n is a, c, g, or t
  misc_feature (495)..(496): n is a, c, g, or t
  misc_feature (499)..(499): n is a, c, g, or t
  misc_feature (504)..(504): n is a, c, g, or t
  misc_feature (508)..(509): n is a, c, g, or t
  misc_feature (512)..(512): n is a, c, g, or t
  misc_feature (526)..(527): n is a, c, g, or t
  misc_feature (529)..(529): n is a, c, g, or t
  misc_feature (537)..(537): n is a, c, g, or t
  misc_feature (547)..(547): n is a, c, g, or t
  misc_feature (549)..(549): n is a, c, g, or t
  misc_feature (552)..(552): n is a, c, g, or t
taagaggagaattaactatgagaggatcgcatcaccatcaccatcacggatcctatttaggtgacactatagaatcgtcgacccacgcgtccgcccacgcgtccgcccacgcgtccgagcagaggttgatctttgccggaaaacagctggaagatggtcgcaccctgtctgactacaacatccagaaagagtccaccttgcacctggtgctccgtctcagaggtgggatgcagatcttcgtgaagaccctgactggtaaancatcactctcgaggnggagccgagnganccattgagaatgncagggcaaagancnaaaaaaggganggctnccctcngaacaacaaaagttgttnttttgtgggaaaancntggaaaaangngcncnccctttttggtttaaaaanttccaaaaaaaggcccccccngccnccnggggggnccccttttaaaggggggggagnaaaattnttttttggaaaaaccctttnnngnnganaaaancccnnccncctcaggggggggnncnggggggcncccctttttngnaang

SEQ ID NO: 357 - DNA, 948 bp, Homo sapiens
  misc_feature (2)..(2): n is a, c, g, or t
  misc_feature (4)..(12): n is a, c, g, or t
  misc_feature (16)..(16): n is a, c, g, or t
  misc_feature (21)..(21): n is a, c, g, or t
  misc_feature (23)..(23): n is a, c, g, or t
  misc_feature (30)..(30): n is a, c, g, or t
  misc_feature (41)..(41): n is a, c, g, or t
  misc_feature (45)..(45): n is a, c, g, or t
  misc_feature (59)..(59): n is a, c, g, or t
  misc_feature (62)..(62): n is a, c, g, or t
  misc_feature (383)..(383): n is a, c, g, or t
  misc_feature (587)..(587): n is a, c, g, or t
  misc_feature (750)..(750): n is a, c, g, or t
  misc_feature (822)..(822): n is a, c, g, or t
  misc_feature (847)..(848): n is a, c, g, or t
  misc_feature (866)..(866): n is a, c, g, or t
  misc_feature (876)..(877): n is a, c, g, or t
  misc_feature (887)..(887): n is a, c, g, or t
  misc_feature (891)..(891): n is a, c, g, or t
  misc_feature (896)..(896): n is a, c, g, or t
  misc_feature (912)..(912): n is a, c, g, or t
  misc_feature (917)..(917): n is a, c, g, or t
  misc_feature (925)..(925): n is a, c, g, or t
  misc_feature (930)..(930): n is a, c, g, or t
  misc_feature (932)..(932): n is a, c, g, or t
  misc_feature (936)..(936): n is a, c, g, or t
  misc_feature (942)..(942): n is a, c, g, or t
  misc_feature (944)..(944): n is a, c, g, or t
tntnnnnnnnnncctnctcgngnattatcntatgtagaggntcgnatcaccatcaccantcncgggatcctatttaggtgacactatagaatcgtcgacccacgcgtccgccggaccgcatctccccccacgggggtcggtgcctggggatcctgtccgcatccactgcaacatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcanaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggntgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaaanaaggagccgactttcattctactttaacttttcctttaaagaaaacttttcccttttgacccaccatttgtncaggggtttgtgtctccagtccctnntctggaggggtatgtttnttggggcggnngggccccatnctgncatgnaaaactttctcacccnaaaanaggggctnggaancnaagngccctncntccc

SEQ ID NO: 358 - DNA, 984 bp, Homo sapiens
ctatgagaggatcgcatcaccatcaccatcacggatcctatttaggtgacactatagaatcgtcgacccacgcgtccggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaagtaa

SEQ ID NO: 359 - DNA, 874 bp, Homo sapiens
  misc_feature (710)..(710): n is a, c, g, or t
agagattactatgagaggtcgcatcccatcaccatcacggatcctatttaggtgacactatagaatcgtcgactctggaccttggctgtcactcagttgattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcatgcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaaggcanggccgtctggatggggctctctgctcctacacggagaaaggacagcaggcgtatctggaggcagcctatgcagccggcgtccgcaatatcgagatggagtcctcggtgtttgccgccatgtgcagcgcctgcggcctccagcggccgtgtgtgtgtcacctcct

SEQ ID NO: 360 - DNA, 1314 bp, Homo sapiens
  misc_feature (1)..(1): n is a, c, g, or t
  misc_feature (617)..(617): n is a, c, g, or t
ncatataatgacttacctataaaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgngcgtcaccgtgttcattgtcagcaccggccgaggcaacttcctggagctgtcagccgctgcctcagcccctgccgagaagcacctgcactttgtggacgtgcatgacctgcaccttcattgtccaagaactgaaggggtccatctccacgcaatgcggccgcaccagctccatgccacggagaatcagttccagggctttcgcctgggctggcccacccctgctgaacgcaaaatccggctaactatgtggtggagattgtgccccaccctcatccctgggggtcataaaacgcccaatctccctcggaacccacagaacggaatttcgacacccccatcccccttcttcaaattacacttcggctactggccaagaacaaaagctccctacctaaagcctcaaacacacccacgactaatacaaatccattatcaccataatcaaccactctactatacctcatcccaatgtgataacctaccccttttctacttactcacttacatctcaaatacattctcacaccactataagtaaccaacccactatcaaactcaaaaccacaagaacccaacttatataatattcctactcatcacacactcatctcaaaacaacaacatctcgacaaccaatgcaaatcaacaaaggtcaatcactaaatgccagcttccactcactatatcaaacctcct

SEQ ID NO: 361 - DNA, 1167 bp, Homo sapiens
  misc_feature (842)..(842): n is a, c, g, or t
  misc_feature (980)..(980): n is a, c, g, or t
  misc_feature (983)..(983): n is a, c, g, or t
  misc_feature (1013)..(1013): n is a, c, g, or t
  misc_feature (1022)..(1022): n is a, c, g, or t
  misc_feature (1036)..(1036): n is a, c, g, or t
  misc_feature (1039)..(1039): n is a, c, g, or t
  misc_feature (1046)..(1046): n is a, c, g, or t
  misc_feature (1050)..(1050): n is a, c, g, or t
  misc_feature (1053)..(1053): n is a, c, g, or t
  misc_feature (1057)..(1058): n is a, c, g, or t
  misc_feature (1064)..(1064): n is a, c, g, or t
  misc_feature (1072)..(1072): n is a, c, g, or t
  misc_feature (1076)..(1076): n is a, c, g, or t
  misc_feature (1082)..(1082): n is a, c, g, or t
  misc_feature (1086)..(1086): n is a, c, g, or t
  misc_feature (1090)..(1090): n is a, c, g, or t
  misc_feature (1099)..(1099): n is a, c, g, or t
  misc_feature (1102)..(1102): n is a, c, g, or t
  misc_feature (1110)..(1110): n is a, c, g, or t
  misc_feature (1116)..(1116): n is a, c, g, or t
  misc_feature (1136)..(1136): n is a, c, g, or t
  misc_feature (1146)..(1146): n is a, c, g, or t
  misc_feature (1156)..(1157): n is a, c, g, or t
  misc_feature (1160)..(1160): n is a, c, g, or t
  misc_feature (1164)..(1164): n is a, c, g, or t
tagagaaattactatgagaggatcgcatcaccatcaccatcacggatcctatttaggtgacactatagaatcgtcgacccacgcgtccgcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttanaggaagagattccacttgcacggcaacagagccttacgttaaaattttcagtccagttatgaacagcaagtgttgaactctttctgcttgttttgattcaaagtgcagttactgatgttgttttgatatgcaactaantangcctccaaagcctctctagtggcaaaacanctcaaactncccccgctgggaanganggcttcngccnaanaccnnccttgngttctgangcangggaancatnggtncaagttccnccngctggggncaaaantgctccaaggtggccaaggntttttttttngggctccttnnganctgnagg

SEQ ID NO: 362 - DNA, 1032 bp, Homo sapiens
  misc_feature (828)..(828): n is a, c, g, or t
  misc_feature (863)..(863): n is a, c, g, or t
  misc_feature (906)..(907): n is a, c, g, or t
  misc_feature (916)..(917): n is a, c, g, or t
  misc_feature (944)..(944): n is a, c, g, or t
  misc_feature (946)..(946): n is a, c, g, or t
  misc_feature (951)..(951): n is a, c, g, or t
  misc_feature (955)..(956): n is a, c, g, or t
  misc_feature (962)..(962): n is a, c, g, or t
  misc_feature (980)..(983): n is a, c, g, or t
  misc_feature (993)..(993): n is a, c, g, or t
  misc_feature (1003)..(1003): n is a, c, g, or t
  misc_feature (1017)..(1018): n is a, c, g, or t
  misc_feature (1020)..(1020): n is a, c, g, or t
  misc_feature (1027)..(1027): n is a, c, g, or t
  misc_feature (1030)..(1030): n is a, c, g, or t
  misc_feature (1032)..(1032): n is a, c, g, or t
gattactatgagaggatcgcatcaccatcaccatcacggatcctatttaggtgacactatagaatcgtcgacccacgcgtccggtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaaacgtaaggcagtggaagatgcacgctgctgtcattgccgctgtgaagccnctcagctccagcagtgtcctacaggaaccccccancccaaaaaggcagctgtggctgtttgtcccgcttgtctctgannaacaaatcnntcccctgtgcctgaaaccaaaaaaatncnaaaanaacnntctttntggctgcctcccaacccnnnnccttctttcnaattcctccnccccccgggaaggnntntgggccnttncn

SEQ ID NO: 363 - DNA, 879 bp, Homo sapiens
  misc_feature (733)..(733): n is a, c, g, or t
  misc_feature (761)..(761): n is a, c, g, or t
agatactatgagaggtcgcatcaccatcaccatcacggatcctatttaggtgaactatagaatcgtcgactctggaccttggctgtcactcagttagtgtaaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaggcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaagttgatgnatcagtgagtgtaaatgacatagatttnagcctgtacatcccaagagatgtagatgaaacaggtattactgtagccagtctttgaagatcagcacatatacttcgaataagatgaaacaattaagtgagcttctggagtaggctga

SEQ ID NO: 364 - DNA, 1172 bp, Homo sapiens
  misc_feature (2)..(3): n is a, c, g, or t
  misc_feature (19)..(19): n is a, c, g, or t
  misc_feature (892)..(892): n is a, c, g, or t
  misc_feature (904)..(904): n is a, c, g, or t
  misc_feature (929)..(929): n is a, c, g, or t
  misc_feature (974)..(974): n is a, c, g, or t
  misc_feature (985)..(985): n is a, c, g, or t
  misc_feature (994)..(994): n is a, c, g, or t
  misc_feature (998)..(998): n is a, c, g, or t
  misc_feature (1003)..(1003): n is a, c, g, or t
  misc_feature (1010)..(1010): n is a, c, g, or t
  misc_feature (1022)..(1022): n is a, c, g, or t
  misc_feature (1027)..(1027): n is a, c, g, or t
  misc_feature (1037)..(1037): n is a, c, g, or t
  misc_feature (1040)..(1040): n is a, c, g, or t
  misc_feature (1045)..(1045): n is a, c, g, or t
  misc_feature (1048)..(1048): n is a, c, g, or t
  misc_feature (1051)..(1051): n is a, c, g, or t
  misc_feature (1060)..(1060): n is a, c, g, or t
  misc_feature (1062)..(1062): n is a, c, g, or t
  misc_feature (1075)..(1075): n is a, c, g, or t
  misc_feature (1082)..(1083): n is a, c, g, or t
  misc_feature (1085)..(1085): n is a, c, g, or t
  misc_feature (1089)..(1089): n is a, c, g, or t
  misc_feature (1095)..(1096): n is a, c, g, or t
  misc_feature (1103)..(1104): n is a, c, g, or t
  misc_feature (1108)..(1109): n is a, c, g, or t
  misc_feature (1121)..(1121): n is a, c, g, or t
  misc_feature (1135)..(1136): n is a, c, g, or t
  misc_feature (1144)..(1144): n is a, c, g, or t
  misc_feature (1152)..(1152): n is a, c, g, or t
gnnatatagagagaattanctatggagaggatcgcatcaccatcaccatcacggatcctatttaggtgacactatagaatcgtcgacccacgcgtccgcccacgcgtccgctgacacgcacgactccccccgcggcaactgcacaggttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacagggagaaaaaccctatctgtgtactcaatgtgggaaagtctttacccctcaaatcaaaccttcattacncatcaaaaaaantcattaccgggcaaaaaaccctaanaaaatgccagtggaatgtggaaaaaccttttttcccaaaaatcanaacctcttttnaaaccttcngganaattncataccngggaaaaaaaanccttnagaaattgcncgnggaanggnggnaaaaaggcntnctccccaaaactncaacccnntngtantccttnnaaaaacnncctnnccggaaaaaaanccctttgaattccnntgaatggngggaaggnctttccccaaaaaaatctcc

SEQ ID NO: 365 - DNA, 1211 bp, Homo sapiens
  misc_feature (7)..(7): n is a, c, g, or t
  misc_feature (796)..(796): n is a, c, g, or t
  misc_feature (803)..(803): n is a, c, g, or t
  misc_feature (931)..(931): n is a, c, g, or t
  misc_feature (949)..(949): n is a, c, g, or t
  misc_feature (958)..(958): n is a, c, g, or t
  misc_feature (964)..(964): n is a, c, g, or t
  misc_feature (969)..(969): n is a, c, g, or t
  misc_feature (974)..(974): n is a, c, g, or t
  misc_feature (981)..(981): n is a, c, g, or t
  misc_feature (984)..(984): n is a, c, g, or t
  misc_feature (994)..(994): n is a, c, g, or t
  misc_feature (1000)..(1000): n is a, c, g, or t
  misc_feature (1004)..(1004): n is a, c, g, or t
  misc_feature (1019)..(1019): n is a, c, g, or t
  misc_feature (1023)..(1024): n is a, c, g, or t
  misc_feature (1040)..(1040): n is a, c, g, or t
  misc_feature (1048)..(1048): n is a, c, g, or t
  misc_feature (1069)..(1070): n is a, c, g, or t
  misc_feature (1080)..(1080): n is a, c, g, or t
  misc_feature (1086)..(1086): n is a, c, g, or t
  misc_feature (1089)..(1089): n is a, c, g, or t
  misc_feature (1103)..(1104): n is a, c, g, or t
  misc_feature (1112)..(1112): n is a, c, g, or t
  misc_feature (1120)..(1121): n is a, c, g, or t
  misc_feature (1123)..(1123): n is a, c, g, or t
  misc_feature (1126)..(1126): n is a, c, g, or t
  misc_feature (1130)..(1130): n is a, c, g, or t
  misc_feature (1143)..(1143): n is a, c, g, or t
  misc_feature (1146)..(1146): n is a, c, g, or t
  misc_feature (1151)..(1151): n is a, c, g, or t
  misc_feature (1156)..(1156): n is a, c, g, or t
  misc_feature (1162)..(1163): n is a, c, g, or t
  misc_feature (1168)..(1168): n is a, c, g, or t
  misc_feature (1176)..(1176): n is a, c, g, or t
  misc_feature (1181)..(1181): n is a, c, g, or t
  misc_feature (1184)..(1184): n is a, c, g, or t
  misc_feature (1192)..(1192): n is a, c, g, or t
  misc_feature (1200)..(1200): n is a, c, g, or t
  misc_feature (1202)..(1202): n is a, c, g, or t
  misc_feature (1211)..(1211): n is a, c, g, or t
tagaggnaattactatggagaggatcgcatcaccatcaccatcacgggatcctatttaggtgacactatagaatcgtcgacccacgcgtccgctcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccagcactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgangcagganaatggcgtgaacccgggaggcggagcttgcagtgagccgagatcacgccactgcactcaagcctgggcgacagagcgagactccgtctcaaaaaaaaaaaaaagaaaattcctactagagagaacccntacaaatataaagaatgnggcaaatcnttttancgggncttcnacctttnctnaacataaggnaattcntacnggaattaaactctanaatnnggaaaaagggggcaancctttttncgggccccccccctacccganntaaaaaaatncttccnggncagcaccctacaanngggaaaanttggcaanncnttnaccngttttcccccttnctncgaanaaaanaccccnntgggnaaaaaacnttaanggngggaaaangggggaangncttaaaaan

SEQ ID NO: 366 - DNA, 837 bp, Homo sapiens
  misc_feature (723)..(724): n is a, c, g, or t
  misc_feature (761)..(762): n is a, c, g, or t
aggtcgcatcaccatcaccatcacggatcctatttaggtgacactatagaatcgtcgactctggaccttggctgtcactcagttaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgctccctatagtgagtcgtattaagcttaattagctgagcttggactcctgttgatagatccagtaatgacctcagaactccatctggatttgttcagaacgctcggttgccgccgggcgttttttattgnntgagatccagctagcttggcgagattttcagagctanngagctaaatggagaaaaatcactggaatacaccgtgattatccatggctcgtaagacatttgagcattcagtcgt

SEQ ID NO: 367 - DNA, 1169 bp, Homo sapiens
  misc_feature (871)..(871): n is a, c, g, or t
  misc_feature (936)..(936): n is a, c, g, or t
  misc_feature (954)..(954): n is a, c, g, or t
  misc_feature (990)..(990): n is a, c, g, or t
  misc_feature (1002)..(1002): n is a, c, g, or t
  misc_feature (1015)..(1015): n is a, c, g, or t
  misc_feature (1045)..(1045): n is a, c, g, or t
  misc_feature (1061)..(1061): n is a, c, g, or t
  misc_feature (1067)..(1067): n is a, c, g, or t
  misc_feature (1069)..(1069): n is a, c, g, or t
  misc_feature (1079)..(1079): n is a, c, g, or t
  misc_feature (1082)..(1082): n is a, c, g, or t
  misc_feature (1084)..(1084): n is a, c, g, or t
  misc_feature (1086)..(1086): n is a, c, g, or t
  misc_feature (1091)..(1091): n is a, c, g, or t
  misc_feature (1094)..(1094): n is a, c, g, or t
  misc_feature (1098)..(1098): n is a, c, g, or t
  misc_feature (1104)..(1104): n is a, c, g, or t
  misc_feature (1118)..(1118): n is a, c, g, or t
  misc_feature (1127)..(1127): n is a, c, g, or t
  misc_feature (1136)..(1136): n is a, c, g, or t
  misc_feature (1158)..(1158): n is a, c, g, or t
  misc_feature (1160)..(1160): n is a, c, g, or t
  misc_feature (1165)..(1165): n is a, c, g, or t
  misc_feature (1168)..(1168): n is a, c, g, or t
tagagaaattactatgagaggatcgcatcaccatcaccatcacggatcctatttaggtgacactatagaatcgtcgacccacgcgtccgagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcangctatatctatgttcatggccagctgctatttgatagaccatgcacgtcaagatggatgagaggncttaccaaaaggagattnctttccctcctgagcgtccccacacttcccatggcntggtggtattgncatgggttagacnggaggcacccttgagccatccctgaataangcctcgaatggaactnggtccncnggatggaggnccntngnggggntgnaaantggtcnattgatttggaganctggccganaatgaatcntatatgcctgaaaaagaaaatntncaacnggng

SEQ ID NO: 368 - DNA, 949 bp, Homo sapiens
ctatgagaggtcgcatcaccatcaccatcacggatcctatttaggtgacactatagaatcgtcgacccacgcgtccgcggacgcgtgggtgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctg

SEQ ID NO: 369 - DNA, 1427 bp, Homo sapiens
  misc_feature (1)..(1): n is a, c, g, or t
  misc_feature (12)..(12): n is a, c, g, or t
nggcgccgcctnccgggagatactagagaggatgcatcaccatcaccatcacggtcgacccacgcgtccgcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgtgcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcaatcatcgacacccccgggatcctgtctggagagaagcatcggatcagcagaggctatgactttgccagccgcctggagcggatcccggaacgagcgaaccgcatcatcctgctcttcgacgcccacaagctggacatcaccgatgagaaccccgaagaagataaggctcccaaaaaccatgaagaaaaaaaaacgctcggggtttaaaaaagtgatccccaatagaaaccacaccaattcaaatagaacaatgacccccccatgtgaacccagcgcaaagaccaaaataacacccatcttaatcaccacgattatccaaaaacagtaaccacccaattcaaactaaccaaagtaaccaaccttaacgaatacactaataataaaaacaaaataaaaaacactgcataaaaccaccacacctcaaataagacacaacaaaaattataataataccacaatcaccactaatccaaaccatctatacacacttaaaatacctacaatacaccatccaacacatcaccacaacacaaaagataccaaacctaacaacaaacaagataattaaatcaataatcaaactcaatcaagttaaacgtacctaacaacaatgtactcaacatcaccacatccaccccctaaaccacaaaacctaccaatacctcacctcatcccatagacccacacacaacaaaataactgagatatcgtataaccatacatgaacacatcacacaaaatatcactctccctgtctacact

SEQ ID NO: 370 - DNA, 489 bp, Homo sapiens
atggctgtgctgccggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcagatcaagcaagagacaggctccttagcaaaaatatgctgtcatgtcaggaggtga

SEQ ID NO: 371 - DNA, 889 bp, Homo sapiens
  misc_feature (771)..(771): n is a, c, g, or t
  misc_feature (781)..(782): n is a, c, g, or t
  misc_feature (820)..(820): n is a, c, g, or t
  misc_feature (880)..(880): n is a, c, g, or t
agagatactatgagaggtcgcatcccatcaccatcacggatcctatttaggtgacactatagaatcgtcgactctggaccttggctgtcactcagttagcgcggcctgccgggacggccttcgggcagtgatggattgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagccctcctccgacaatgagtcccccctcttgtctccaccctgagattggcatggngtgcggtgtnnggggctgtgctgcctgtggtatggtttttttgccgggnggttgctttttcctgggccttaactcccaaataaaccttcctttgagaaaccactctttngaaaaagaa

SEQ ID NO: 372 - DNA, 345 bp, Homo sapiens
atgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctga

SEQ ID NO: 373 - DNA, 1142 bp, Homo sapiens
  misc_feature (907)..(907): n is a, c, g, or t
  misc_feature (934)..(934): n is a, c, g, or t
  misc_feature (954)..(954): n is a, c, g, or t
  misc_feature (997)..(997): n is a, c, g, or t
  misc_feature (1004)..(1004): n is a, c, g, or t
  misc_feature (1008)..(1008): n is a, c, g, or t
  misc_feature (1014)..(1014): n is a, c, g, or t
  misc_feature (1026)..(1026): n is a, c, g, or t
  misc_feature (1033)..(1033): n is a, c, g, or t
  misc_feature (1037)..(1037): n is a, c, g, or t
  misc_feature (1040)..(1041): n is a, c, g, or t
  misc_feature (1046)..(1046): n is a, c, g, or t
  misc_feature (1055)..(1055): n is a, c, g, or t
  misc_feature (1058)..(1058): n is a, c, g, or t
  misc_feature (1081)..(1081): n is a, c, g, or t
  misc_feature (1083)..(1083): n is a, c, g, or t
  misc_feature (1087)..(1087): n is a, c, g, or t
  misc_feature (1091)..(1091): n is a, c, g, or t
  misc_feature (1098)..(1098): n is a, c, g, or t
  misc_feature (1104)..(1104): n is a, c, g, or t
  misc_feature (1109)..(1110): n is a, c, g, or t
  misc_feature (1113)..(1115): n is a, c, g, or t
  misc_feature (1123)..(1123): n is a, c, g, or t
  misc_feature (1131)..(1131): n is a, c, g, or t
  misc_feature (1134)..(1134): n is a, c, g, or t
agagaaattactatgagaggatcgcatcaccatcaccatcacggatcctatttaggtgacactatagaatcgtcgacccacgcgtccggggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccanaaccagagagagattatcttgaagcancaattcgaacagttatccanattcatatgtgtgaaaagaaaaaggaaatcttcttcttttctnaactggncaanaggaantgatgaacctgnaaaaaanaaancgnnaattnagatttggnccngaaattggggacttaaaatcatncntggnatcnaacttcncctcanagcannaannntttttgancccccccnccnaaaaaaaa

SEQ ID NO: 374 - DNA, 3114 bp, Homo sapiens
atggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaggctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccctaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatag

SEQ ID NO: 375 - DNA, 631 bp, Homo sapiens
ctatgagaggtcgcatcaccatcaccatcacggatcctatttaggtgacactatagaatcgtcgactctggaccttggctgtcactcagttggagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaggtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgatgactaatgacatccagtgtctccaaaattgtttccttgtactgatataaacacttccaaat

SEQ ID NO: 376 - DNA, 601 bp, Homo sapiens
  misc_feature (476)..(476): n is a, c, g, or t
  misc_feature (499)..(499): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (544)..(544): n is a, c, g, or t
  misc_feature (550)..(550): n is a, c, g, or t
  misc_feature (552)..(553): n is a, c, g, or t
  misc_feature (556)..(556): n is a, c, g, or t
  misc_feature (559)..(559): n is a, c, g, or t
  misc_feature (561)..(561): n is a, c, g, or t
  misc_feature (564)..(564): n is a, c, g, or t
  misc_feature (581)..(581): n is a, c, g, or t
  misc_feature (590)..(590): n is a, c, g, or t
  misc_feature (597)..(599): n is a, c, g, or t
  misc_feature (601)..(601): n is a, c, g, or t
agagagaattactatgagaggatcgcatcaccatcaccatcacggatcctatttaggtgacactatagaatcgtcgacccacgcgtccgagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcanagcgaatagggccgccgccgccnccgcctccgcagccgccgtcagcatngcngcngcccctgccgccnccgccncnnccnccntncgncgctgccaccgccgcgncaaccctgnacctggnnngn

SEQ ID NO: 377 - DNA, 846 bp, Homo sapiens
  misc_feature (1)..(1): n is a, c, g, or t
  misc_feature (819)..(819): n is a, c, g, or t
  misc_feature (827)..(828): n is a, c, g, or t
nttatgagaaatactatgagaggatgcatcccatcaccatcacggatcctatttaggtgacactatagaatcgtcgactctggaccttggctgtcactcagttttgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaattttatttctcattcttttgacatactatactaatatatttatgttgctaattgctctatctgcatgttaacaagatatatacttcgatgaangtattatnngaaaattactgtttaaaa

SEQ ID NO: 378 - DNA, 689 bp, Homo sapiens
  misc_feature (1)..(1): n is a, c, g, or t
naatagagagattactatgagaggatcgcatcaccatcaccatcacggatcctatttaggtgacactatagaatcgtcgacccacgcgtccggcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 379 - DNA, 849 bp, Homo sapiens
atggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtag

SEQ ID NO: 380 - DNA, 480 bp, Homo sapiens
atgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataa

SEQ ID NO: 381 - DNA, 567 bp, Homo sapiens
atgaacggagacgacgcctttgcaaggagacccacggttggtgctcaaataccagagaagatccaaaaggccttcgatgatattgccaaatacttctctaaggaagagtgggaaaagatgaaagcctcagagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcctgagagaaaacagctggtgatttatgaagagatcagcgaccctgaggaagatgacgagtaa

SEQ ID NO: 382 - DNA, 1204 bp, Homo sapiens
  misc_feature (849)..(849): n is a, c, g, or t
  misc_feature (914)..(914): n is a, c, g, or t
  misc_feature (916)..(916): n is a, c, g, or t
  misc_feature (923)..(923): n is a, c, g, or t
  misc_feature (942)..(943): n is a, c, g, or t
  misc_feature (948)..(948): n is a, c, g, or t
  misc_feature (963)..(963): n is a, c, g, or t
  misc_feature (968)..(968): n is a, c, g, or t
  misc_feature (974)..(974): n is a, c, g, or t
  misc_feature (992)..(992): n is a, c, g, or t
  misc_feature (1029)..(1029): n is a, c, g, or t
  misc_feature (1031)..(1031): n is a, c, g, or t
  misc_feature (1033)..(1033): n is a, c, g, or t
  misc_feature (1040)..(1040): n is a, c, g, or t
  misc_feature (1047)..(1047): n is a, c, g, or t
  misc_feature (1054)..(1054): n is a, c, g, or t
  misc_feature (1057)..(1057): n is a, c, g, or t
  misc_feature (1063)..(1063): n is a, c, g, or t
  misc_feature (1080)..(1080): n is a, c, g, or t
  misc_feature (1121)..(1121): n is a, c, g, or t
  misc_feature (1126)..(1126): n is a, c, g, or t
  misc_feature (1129)..(1129): n is a, c, g, or t
  misc_feature (1131)..(1131): n is a, c, g, or t
  misc_feature (1138)..(1138): n is a, c, g, or t
  misc_feature (1142)..(1142): n is a, c, g, or t
  misc_feature (1148)..(1149): n is a, c, g, or t
  misc_feature (1158)..(1158): n is a, c, g, or t
  misc_feature (1163)..(1163): n is a, c, g, or t
  misc_feature (1168)..(1168): n is a, c, g, or t
  misc_feature (1172)..(1172): n is a, c, g, or t
  misc_feature (1183)..(1183): n is a, c, g, or t
  misc_feature (1188)..(1188): n is a, c, g, or t
  misc_feature (1190)..(1190): n is a, c, g, or t
  misc_feature (1193)..(1193): n is a, c, g, or t
  misc_feature (1195)..(1195): n is a, c, g, or t
  misc_feature (1197)..(1197): n is a, c, g, or t
tagagaaattactatgagaggatcgcatcaccatcaccatcacggatcctatttaggtgacactatagaatcgtcgacccacgcgtccgcccacgcgtccggtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaancattggagctggtcccatccccatcaagacacccgtgatccctgtcaagaccccaaccgtcccananctcccangggtgttgccagcccctcnnatggncaaaaaacgggggancacancctgantcccatctgtggtgaggnccccaagggtcacaacatgccctcctcatgtgaacgncnancttcgtnaacctcncttcagnccnaaccantatcctgagaacaaaanggcattccaaaatgaactaaaacagaagggaacccaatgcntgttnccngncaattcnaaangacctnnaactgaccnagganttccnaggnaaaaatttaancctcnanggngnantaaaaaa

SEQ ID NO: 383 - DNA, 881 bp, Homo sapiens
  misc_feature (608)..(608): n is a, c, g, or t
aagagagatactatgagaggtcgcatcaccatcccatcacggatcctatttaggtgacactatagaatcgtcgactctggaccttggctgtcactcagttacgctgctggcctccaatgaagcctttaaaaagcaggcttttagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggnccttgtccacactctccaagcacattacaggggacctgattgctacacgttcagaatgcgttgctgtcatcctgcttggcctggccaggcctgacacagccttggcttccacgcctgaacgtggagagcacgagtaatttgtagtccgcttgccgtggggctgaactcctggtggcttgacgccctttttggttgccccctggtgttttccttgacccccaagaggtgggtggaagaagggactggagttccctgagggcaaaaaagttgcct

SEQ ID NO: 384 - DNA, 1179 bp, Homo sapiens
  misc_feature (1)..(1): n is a, c, g, or t
  misc_feature (887)..(887): n is a, c, g, or t
  misc_feature (990)..(990): n is a, c, g, or t
  misc_feature (998)..(998): n is a, c, g, or t
  misc_feature (1014)..(1014): n is a, c, g, or t
  misc_feature (1020)..(1020): n is a, c, g, or t
  misc_feature (1030)..(1030): n is a, c, g, or t
  misc_feature (1038)..(1038): n is a, c, g, or t
  misc_feature (1056)..(1056): n is a, c, g, or t
  misc_feature (1064)..(1064): n is a, c, g, or t
  misc_feature (1087)..(1087): n is a, c, g, or t
  misc_feature (1100)..(1100): n is a, c, g, or t
  misc_feature (1112)..(1112): n is a, c, g, or t
  misc_feature (1129)..(1129): n is a, c, g, or t
  misc_feature (1137)..(1137): n is a, c, g, or t
  misc_feature (1147)..(1147): n is a, c, g, or t
  misc_feature (1156)..(1156): n is a, c, g, or t
  misc_feature (1160)..(1161): n is a, c, g, or t
  misc_feature (1168)..(1168): n is a, c, g, or t
  misc_feature (1170)..(1170): n is a, c, g, or t
  misc_feature (1179)..(1179): n is a, c, g, or t
naattagagaaattactatgagaggatcgcatcaccatcaccatcacggatcctatttaggtgacactatagaatcgtcgacccacgcgtccggagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtcaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagcagcggagctggctgtacctagaagagatggtcaactccttgctcaacacagcgcagcagctgaagacgctgtttgagcaagccaagcatgccagcacctaccgagaagctgccacaaaccaggccaagatccacgctgacgcaaagcggaaggagcagtcctgcgttaactgcggccgggangctatgaacgagtgcaccggctgccacaaggtcaactactgctccaccttctgccaacgcaaggactggaaggatcaccagcacatatgcggccagtcagcanctgtcacngtccaggcaaaaaaantccacntggctgaaancgtgatgnaaaagggaccgtgtgagntccatcgncccccctgggaactggggccctnccatcctggaagnttttgcaggtcnaaggccccttgagaatntgggggantttaaaaaanggggtgggnaagnnaaaaaantnttggaaaan

SEQ ID NO: 385 - DNA, 938 bp, Homo sapiens
ggatcgcatcaccatcaccatcacggatcctatttaggtgacactatagaatcgtcgacccacgcgtccggaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcggcagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggccggcgggcgcgcccgaagcgcccatcctcgtggtaggcaacaagcgggacaggcagcggctgcgcttcggaccgcggcgcgcgctggccgccctagtgcgc

SEQ ID NO: 386 - DNA, 744 bp, Homo sapiens
gagatactatgagaggtcgcatcccatcccatcacggatcctatttaggtgacactatagaatcgtcgactctggaccttggctgtcactcagttgacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaaataagccatttcagaaag

SEQ ID NO: 387 - DNA, 600 bp, Homo sapiens
atggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctga

SEQ ID NO: 388 - DNA, 779 bp, Homo sapiens
  misc_feature (636)..(636): n is a, c, g, or t
atagagagattactatgagaggtcgcatcccatcaccatcacggatcctatttaggtgacactatagaatcgtcgactctggaccttggctgtcactcagttcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgcgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtangcagtggaaaacttgcaaggaaagctgccgtctctttggcagcctgatgcaaagcctgcactctggcactcgctgaagaatctggaaggttgcggtttgctctttccgtgttcgggggcctctggctgctgaagggatcggtc

SEQ ID NO: 389 - DNA, 1198 bp, Homo sapiens
  misc_feature (918)..(919): n is a, c, g, or t
  misc_feature (969)..(969): n is a, c, g, or t
  misc_feature (1012)..(1012): n is a, c, g, or t
  misc_feature (1041)..(1041): n is a, c, g, or t
  misc_feature (1052)..(1052): n is a, c, g, or t
  misc_feature (1055)..(1055): n is a, c, g, or t
  misc_feature (1068)..(1068): n is a, c, g, or t
  misc_feature (1070)..(1070): n is a, c, g, or t
  misc_feature (1081)..(1081): n is a, c, g, or t
  misc_feature (1087)..(1089): n is a, c, g, or t
  misc_feature (1096)..(1096): n is a, c, g, or t
  misc_feature (1101)..(1101): n is a, c, g, or t
  misc_feature (1104)..(1104): n is a, c, g, or t
  misc_feature (1113)..(1113): n is a, c, g, or t
  misc_feature (1121)..(1121): n is a, c, g, or t
  misc_feature (1126)..(1126): n is a, c, g, or t
  misc_feature (1129)..(1129): n is a, c, g, or t
  misc_feature (1133)..(1133): n is a, c, g, or t
  misc_feature (1135)..(1135): n is a, c, g, or t
  misc_feature (1145)..(1145): n is a, c, g, or t
  misc_feature (1149)..(1149): n is a, c, g, or t
  misc_feature (1162)..(1163): n is a, c, g, or t
  misc_feature (1168)..(1168): n is a, c, g, or t
  misc_feature (1170)..(1170): n is a, c, g, or t
  misc_feature (1184)..(1185): n is a, c, g, or t
tagagaaattactatgagaggatcgcatcaccatcaccatcacggatcctatttaggtgacactatagaatcgtcgacccacgcgtccgcacacttctcggaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgatttggttctagtttttgtgtatatatgtgtttattagacatggcatgctaagaaggttttgttttttttttttaatgnngcatctgtctaatttgtctttgaacaattatgtcgggaggcatttttaanaacaagcaggctggcacttttttatttctctttacaaatgganggaattttttttgcccttggaacatttantttcccgggantgnattttaaaacagnanggtaaactttnttgccnnntttaaanggacnggnttttccaanctttttgnatttnacnttcncncaccaacccngggnattggatggcccnnaaaangnttttcttaaaaaanntcggggttttttt

SEQ ID NO: 390 - DNA, 903 bp, Homo sapiens
  misc_feature (3)..(3): n is a, c, g, or t
  misc_feature (819)..(819): n is a, c, g, or t
  misc_feature (843)..(843): n is a, c, g, or t
  misc_feature (892)..(892): n is a, c, g, or t
cantagagagaattactatgagaggatcgcatcaccatcaccatcacggatcctatttaggtgacactatagaatcgtcgacccacgcgtccgggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgacttttttanagactcgggcgggtgttctgcggncccccaggtgctatgggggaaggggggcgttgaatggaattaaaaccanaaaagaaaagc

SEQ ID NO: 391 - DNA, 1179 bp, Homo sapiens
  misc_feature (4)..(6): n is a, c, g, or t
  misc_feature (1070)..(1070): n is a, c, g, or t
  misc_feature (1081)..(1081): n is a, c, g, or t
  misc_feature (1098)..(1098): n is a, c, g, or t
  misc_feature (1126)..(1126): n is a, c, g, or t
  misc_feature (1129)..(1129): n is a, c, g, or t
  misc_feature (1134)..(1135): n is a, c, g, or t
  misc_feature (1148)..(1148): n is a, c, g, or t
  misc_feature (1152)..(1152): n is a, c, g, or t
  misc_feature (1154)..(1154): n is a, c, g, or t
  misc_feature (1158)..(1158): n is a, c, g, or t
  misc_feature (1160)..(1160): n is a, c, g, or t
  misc_feature (1162)..(1162): n is a, c, g, or t
  misc_feature (1164)..(1174): n is a, c, g, or t
ctcnnnctaagagatactatgagaggatcgcatcaccatcaccatcacggtcgacccacgcgtccgctgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttgggggagctgtgccagaggctggactttctgctgggctccgtggtccatgaggtaacagcttgccctgatgctgtggccaaacagatgggtgaaagtcaagtacgcaaagctgccatacatgggggttgggctgctgctttcggggactcagcccaaaaactactggagtggttgacgccggccctcaggaaccctaccactgctgaacacctaaagggttcgggacccaataccgggccaaatccctgcccagttggccctaaaaaatcggatgacttctgaaaaattcccgttccccccaaaaaattgaaaaaaaattttggccttcccaaacccggctccgggaagtgaagaaggnaaaaggccaanccccaaaccggcccagntttcaaaaggggccccttcctcttaggnggncaaannaaccccccggggntttnanacancncncnnnnnnnnnnnccccc

SEQ ID NO: 392 - DNA, 1168 bp, Homo sapiens
  misc_feature (852)..(852): n is a, c, g, or t
  misc_feature (892)..(892): n is a, c, g, or t
  misc_feature (924)..(924): n is a, c, g, or t
  misc_feature (926)..(926): n is a, c, g, or t
  misc_feature (932)..(932): n is a, c, g, or t
  misc_feature (962)..(962): n is a, c, g, or t
  misc_feature (967)..(967): n is a, c, g, or t
  misc_feature (972)..(972): n is a, c, g, or t
  misc_feature (1040)..(1040): n is a, c, g, or t
  misc_feature (1045)..(1045): n is a, c, g, or t
  misc_feature (1049)..(1049): n is a, c, g, or t
  misc_feature (1052)..(1052): n is a, c, g, or t
  misc_feature (1055)..(1056): n is a, c, g, or t
  misc_feature (1059)..(1059): n is a, c, g, or t
  misc_feature (1070)..(1070): n is a, c, g, or t
  misc_feature (1073)..(1073): n is a, c, g, or t
  misc_feature (1108)..(1109): n is a, c, g, or t
  misc_feature (1112)..(1113): n is a, c, g, or t
  misc_feature (1118)..(1119): n is a, c, g, or t
  misc_feature (1122)..(1122): n is a, c, g, or t
  misc_feature (1132)..(1132): n is a, c, g, or t
  misc_feature (1134)..(1134): n is a, c, g, or t
  misc_feature (1152)..(1152): n is a, c, g, or t
  misc_feature (1160)..(1160): n is a, c, g, or t
agagaaattactatgagaggatcgcatcaccatcaccatcacggatcctatttaggtgacactatagaatcgtcgacccacgcgtccggcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtnccaaaactgcattacttttgtaaaaacactggttaatttngtataagatattatagagctttttatgctttnanaagttnaaccaatatctttgggggggaactattttnttttntcccntgaaatggggtagctcttacaagtttatggatttgatttttttaaaatcaaagccattgaacacgggnatttngacnganaannttnggctgaaaganttnaccctgcctcactgattgccgttaatgaaaaaatnnaannttacnntgnttttcgaccncntttaaattcggtgagttntttggttncaagaagg

SEQ ID NO: 393 - DNA, 381 bp, Homo sapiens
atgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtga

SEQ ID NO: 394 - DNA, 1141 bp, Homo sapiens
  misc_feature (1)..(1): n is a, c, g, or t
  misc_feature (3)..(3): n is a, c, g, or t
  misc_feature (779)..(779): n is a, c, g, or t
  misc_feature (884)..(884): n is a, c, g, or t
  misc_feature (906)..(906): n is a, c, g, or t
  misc_feature (920)..(920): n is a, c, g, or t
  misc_feature (935)..(935): n is a, c, g, or t
  misc_feature (942)..(942): n is a, c, g, or t
  misc_feature (944)..(944): n is a, c, g, or t
  misc_feature (946)..(946): n is a, c, g, or t
  misc_feature (953)..(953): n is a, c, g, or t
  misc_feature (955)..(955): n is a, c, g, or t
  misc_feature (961)..(961): n is a, c, g, or t
  misc_feature (968)..(968): n is a, c, g, or t
  misc_feature (1000)..(1001): n is a, c, g, or t
  misc_feature (1022)..(1022): n is a, c, g, or t
  misc_feature (1028)..(1028): n is a, c, g, or t
  misc_feature (1035)..(1035): n is a, c, g, or t
  misc_feature (1073)..(1073): n is a, c, g, or t
  misc_feature (1076)..(1077): n is a, c, g, or t
  misc_feature (1079)..(1079): n is a, c, g, or t
  misc_feature (1085)..(1085): n is a, c, g, or t
  misc_feature (1093)..(1093): n is a, c, g, or t
  misc_feature (1109)..(1109): n is a, c, g, or t
  misc_feature (1114)..(1114): n is a, c, g, or t
  misc_feature (1129)..(1129): n is a, c, g, or t
  misc_feature (1133)..(1133): n is a, c, g, or t
  misc_feature (1135)..(1135): n is a, c, g, or t
nantagagaaattactatgagaggatcgcatcaccatcaccatcacggatcctatttaggtgacactatagaatcgtcgacccacgcgtccggagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggnagaaaaatccctttgttttaaagtaaagtaaacattatcgctaagtgtacttgtgcagtattaacagctacattatacagtaaatgtgggataaaatccatttanaaaatgttaaactgcttttccngacatgggttgtancatattttcaattantgtgggnangnttaatgngnaaatgnaaaatanaacaaagttacatttttaaaactgctacttgnnataaacccttgcccccttttnccaaanaactggngggttttgggcatagttttttacaaaccttggaatttnccnnancgggcnttttcccngtttggggggttttgnaaaanttacccctttttttngggnanaaaaaa

SEQ ID NO: 395 - DNA, 1252 bp, Homo sapiens
  misc_feature (900)..(900): n is a, c, g, or t
  misc_feature (936)..(936): n is a, c, g, or t
  misc_feature (964)..(964): n is a, c, g, or t
  misc_feature (985)..(985): n is a, c, g, or t
  misc_feature (1014)..(1014): n is a, c, g, or t
  misc_feature (1016)..(1016): n is a, c, g, or t
  misc_feature (1023)..(1023): n is a, c, g, or t
  misc_feature (1032)..(1032): n is a, c, g, or t
  misc_feature (1036)..(1036): n is a, c, g, or t
  misc_feature (1045)..(1045): n is a, c, g, or t
  misc_feature (1075)..(1075): n is a, c, g, or t
  misc_feature (1077)..(1077): n is a, c, g, or t
  misc_feature (1084)..(1084): n is a, c, g, or t
  misc_feature (1091)..(1091): n is a, c, g, or t
  misc_feature (1093)..(1093): n is a, c, g, or t
  misc_feature (1095)..(1095): n is a, c, g, or t
  misc_feature (1101)..(1101): n is a, c, g, or t
  misc_feature (1103)..(1103): n is a, c, g, or t
  misc_feature (1111)..(1111): n is a, c, g, or t
  misc_feature (1113)..(1113): n is a, c, g, or t
  misc_feature (1124)..(1124): n is a, c, g, or t
  misc_feature (1126)..(1126): n is a, c, g, or t
  misc_feature (1130)..(1130): n is a, c, g, or t
  misc_feature (1132)..(1132): n is a, c, g, or t
  misc_feature (1139)..(1139): n is a, c, g, or t
  misc_feature (1149)..(1149): n is a, c, g, or t
  misc_feature (1151)..(1151): n is a, c, g, or t
  misc_feature (1155)..(1155): n is a, c, g, or t
  misc_feature (1158)..(1158): n is a, c, g, or t
  misc_feature (1170)..(1170): n is a, c, g, or t
  misc_feature (1208)..(1208): n is a, c, g, or t
  misc_feature (1213)..(1213): n is a, c, g, or t
  misc_feature (1219)..(1219): n is a, c, g, or t
  misc_feature (1225)..(1225): n is a, c, g, or t
  misc_feature (1239)..(1240): n is a, c, g, or t
  misc_feature (1243)..(1243): n is a, c, g, or t
  misc_feature (1245)..(1245): n is a, c, g, or t
  misc_feature (1252)..(1252): n is a, c, g, or t
attagagaaattactatgagaggatcgcatcaccatcaccatcacggatcctatttaggtgacactatagaatcgtcgacccacgcgtccgctcccctcctcaattcaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacncgaggaaaacgctgcacttacagggaaagggggtcnctttgtttacggagtttggaaaaacccntactgctacttgtgttttggnacttaactgaacttggaaatgggcctgantnaaaaccnctttttttngggnaaatattcntggggtaaccccctttggaggcctttttancnggggttnccttttnantngcccanancccaattntnaaggttttggnantttncnaaaaggntttctaaaangnaaanctnaacccttacttngggacttttttttttttttatgacaacctttacttttnaaaangaaccnaatctnttgggaaagggggnnccnanaattttn

SEQ ID NO: 396 - DNA, 1296 bp, Homo sapiens
atgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactag

SEQ ID NO: 397 - DNA, 861 bp, Homo sapiens
  misc_feature (680)..(680): n is a, c, g, or t
  misc_feature (730)..(730): n is a, c, g, or t
agatactatgagaggtcgcatcccatcaccatcacggatcctatttaggtgacactatagaatcgtcgactctggaccttggctgtcactcagttggaacgaactacatctcccggcaggctgcggaagggggtctagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcangaactacgtcggagttgtgccaccgtccagcggctgcagcacacactccnacaggtgcttgacccaagagaggaagtgcgtcagtccaagcagctcctgcagctgtacctccaggctttggagaaagaaggcagcctcctgtcaaagtaggaagagtccaagctggctttgggtgaggagg

SEQ ID NO: 398 - DNA, 1215 bp, Homo sapiens
  misc_feature (3)..(3): n is a, c, g, or t
  misc_feature (7)..(7): n is a, c, g, or t
  misc_feature (944)..(944): n is a, c, g, or t
  misc_feature (966)..(966): n is a, c, g, or t
  misc_feature (981)..(981): n is a, c, g, or t
  misc_feature (992)..(992): n is a, c, g, or t
  misc_feature (999)..(999): n is a, c, g, or t
  misc_feature (1004)..(1004): n is a, c, g, or t
  misc_feature (1018)..(1018): n is a, c, g, or t
  misc_feature (1021)..(1021): n is a, c, g, or t
  misc_feature (1030)..(1030): n is a, c, g, or t
  misc_feature (1052)..(1052): n is a, c, g, or t
  misc_feature (1070)..(1070): n is a, c, g, or t
  misc_feature (1074)..(1074): n is a, c, g, or t
  misc_feature (1101)..(1101): n is a, c, g, or t
  misc_feature (1111)..(1111): n is a, c, g, or t
  misc_feature (1118)..(1119): n is a, c, g, or t
  misc_feature (1150)..(1150): n is a, c, g, or t
  misc_feature (1153)..(1154): n is a, c, g, or t
  misc_feature (1177)..(1177): n is a, c, g, or t
  misc_feature (1179)..(1179): n is a, c, g, or t
  misc_feature (1202)..(1202): n is a, c, g, or t
  misc_feature (1209)..(1209): n is a, c, g, or t
tanaganattactatgagaggatcgcatcaccatcaccatcacggatcctatttaggtgacactatagaatcgtcgacccacgcgttccgctatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagttttgtcactccagacacagacatcaaggtgaccttgagtatctttgagctggcatctgctgcaggtgtgggctgtgacattgacccagccttggtggctgccatggctatctgaaagctganacttcatctcctgaagaagaanataagggggccggcnggctcttgatnttttggnagttncctcccctccttgncantgacccttnttcctttttaagccttggaaangagggttacaaaaacatnttcntggttgacaaagccatcatccaggggnttggggcctnttccgcnntaaaaaaaaaaattgaaactcccccaggaanttnngggggggccttttcaccccttgnantggccagaaatgaaagtttaaancaaatcngaaacc

SEQ ID NO: 399 - DNA, 669 bp, Homo sapiens
  misc_feature (639)..(639): n is a, c, g, or t
  misc_feature (641)..(641): n is a, c, g, or t
  misc_feature (643)..(643): n is a, c, g, or t
  misc_feature (648)..(648): n is a, c, g, or t
  misc_feature (650)..(653): n is a, c, g, or t
  misc_feature (655)..(669): n is a, c, g, or t
tactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcncngnggggngnnnngnnnnnnnnnnnnnnn

SEQ ID NO: 400 - DNA, 735 bp, Homo sapiens
  misc_feature (714)..(715): n is a, c, g, or t
  misc_feature (734)..(735): n is a, c, g, or t
atagagagattactatgagaggtcgcatcaccatcaccatcacggatcctatttaggtgacactatagaatcgtcgactctggaccttggctgtcactcagttaaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcataggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggcggacacattggaaatccagggtgatgtcaccttgtcctatgtccagatctaatctattcctggggccataactcatggggaaacagaattatcccctaggactcctttctaagcccctaatannatgtctgaggggtgaaaann

SEQ ID NO: 401 - DNA, 2832 bp, Homo sapiens
atggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtattccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacatccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttga

SEQ ID NO: 402 - DNA, 1260 bp, Homo sapiens
atgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaa

SEQ ID NO: 403 - DNA, 435 bp, Homo sapiens
  misc_feature (234)..(234): n is a, c, g, or t
gatactatgagaggtcgcatcaccatcaccatcacggatcctatttaggtgacactatagaatcgtcgactctggaccttggctgtcactcagttagcaaagaagcagcccagctttcagaagcagccccagtgcccacagagccccaggcctcacagctcctggatctgctagatctcctggatggggcttctggggatgtccagcatcctccccatctggacccctccccangaggtgccctggtacacctgcttgaccttccctgtgtacctccacccccaactcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccacg

SEQ ID NO: 404 - DNA, 1112 bp, Homo sapiens
  misc_feature (868)..(868): n is a, c, g, or t
  misc_feature (877)..(877): n is a, c, g, or t
  misc_feature (927)..(927): n is a, c, g, or t
  misc_feature (962)..(962): n is a, c, g, or t
  misc_feature (970)..(970): n is a, c, g, or t
  misc_feature (979)..(979): n is a, c, g, or t
  misc_feature (983)..(983): n is a, c, g, or t
  misc_feature (988)..(988): n is a, c, g, or t
  misc_feature (991)..(991): n is a, c, g, or t
  misc_feature (996)..(996): n is a, c, g, or t
  misc_feature (1030)..(1030): n is a, c, g, or t
  misc_feature (1038)..(1038): n is a, c, g, or t
  misc_feature (1050)..(1050): n is a, c, g, or t
  misc_feature (1053)..(1053): n is a, c, g, or t
  misc_feature (1060)..(1060): n is a, c, g, or t
  misc_feature (1064)..(1064): n is a, c, g, or t
  misc_feature (1080)..(1080): n is a, c, g, or t
  misc_feature (1085)..(1085): n is a, c, g, or t
  misc_feature (1088)..(1089): n is a, c, g, or t
  misc_feature (1091)..(1091): n is a, c, g, or t
  misc_feature (1093)..(1093): n is a, c, g, or t
  misc_feature (1103)..(1103): n is a, c, g, or t
  misc_feature (1105)..(1105): n is a, c, g, or t
  misc_feature (1108)..(1108): n is a, c, g, or t
tagagaaattactatgagaggatcgcatcaccatcaccatcacggatcctatttaggtgacactatagaatcgtcgacccacgcgtccgacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgaaggaggtggcgccggcagcggtgagtgcctggcctggtgggccccctccgcgcaattaacgtgcagctagggcttcccgggggatgggcgactaggaacctccagcctttgctgcctgccttctggcgtttgnaggctgcantaccaggctccggccgaggcctgtggggggcatttgacgttgggaaaaanaacccgcccatgatcgtacttggcgcaaaattaancgctcggnaaatccctnaatncatgnatngatcnggggtaactctgaaaagttgggtgccaaaatttnaaaatttnttttttttgcanttnaatcccnaaantttaaaattgggggcngggcnctnntnantcaaaacctngnaantccc

SEQ ID NO: 405 - DNA, 1626 bp, Homo sapiens
atgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtga

SEQ ID NO: 406 - DNA, 877 bp, Homo sapiens
  misc_feature (811)..(811): n is a, c, g, or t
tagagagatactatgagaggtcgcatcccatcaccatcacggatcctatttaggtgacactatagaatcgtcgactctggaccttggctgtcactcagttggtaaaggtcaggccgaggccggcgcggagaatctgctgtcgcctgcagctgctcgcctgtctccgtcggaagggagcccaagctttgcagagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctggtggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaacctattaacttgccagttgttaaaaacgacctctatagagagggaaaacgggaaaggcgggagcgatctcgatcccgagaagacactgggactcgaggacagggatcgagacatgacagggccngggagagagatggcagaaagagagcgacaggtgtggccgacatgactggagagaggaggacttcaa

SEQ ID NO: 407 - DNA, 1045 bp, Homo sapiens
  misc_feature (2)..(2): n is a, c, g, or t
  misc_feature (905)..(905): n is a, c, g, or t
  misc_feature (932)..(932): n is a, c, g, or t
  misc_feature (973)..(973): n is a, c, g, or t
  misc_feature (985)..(985): n is a, c, g, or t
  misc_feature (989)..(989): n is a, c, g, or t
  misc_feature (1001)..(1001): n is a, c, g, or t
  misc_feature (1006)..(1006): n is a, c, g, or t
  misc_feature (1018)..(1018): n is a, c, g, or t
  misc_feature (1031)..(1031): n is a, c, g, or t
  misc_feature (1042)..(1042): n is a, c, g, or t
cnattagagaaattactatgagaggatcgcatcaccatcaccatcacggaatcctatttaggtgacactatagaatcgtcgacccacgcgtccgcccacgcgtccgcccacgcgtccggttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaantatccaaattaaatccttagcagtcanaacacttgcttccctagaatatgccaactgccaatcatgtnggactgagctantttnttcctctttcgnaactnttagggtaatanttaccataaaaantttcttaaaanggc

SEQ ID NO: 408 - DNA, 1142 bp, Homo sapiens
  misc_feature (908)..(908): n is a, c, g, or t
  misc_feature (916)..(916): n is a, c, g, or t
  misc_feature (964)..(964): n is a, c, g, or t
  misc_feature (988)..(988): n is a, c, g, or t
  misc_feature (1005)..(1005): n is a, c, g, or t
  misc_feature (1013)..(1013): n is a, c, g, or t
  misc_feature (1017)..(1017): n is a, c, g, or t
  misc_feature (1022)..(1022): n is a, c, g, or t
  misc_feature (1039)..(1039): n is a, c, g, or t
  misc_feature (1047)..(1047): n is a, c, g, or t
  misc_feature (1059)..(1059): n is a, c, g, or t
  misc_feature (1063)..(1063): n is a, c, g, or t
  misc_feature (1066)..(1066): n is a, c, g, or t
  misc_feature (1071)..(1071): n is a, c, g, or t
  misc_feature (1075)..(1076): n is a, c, g, or t
  misc_feature (1080)..(1080): n is a, c, g, or t
  misc_feature (1084)..(1084): n is a, c, g, or t
  misc_feature (1088)..(1088): n is a, c, g, or t
  misc_feature (1094)..(1095): n is a, c, g, or t
  misc_feature (1097)..(1097): n is a, c, g, or t
  misc_feature (1102)..(1102): n is a, c, g, or t
  misc_feature (1106)..(1106): n is a, c, g, or t
  misc_feature (1117)..(1117): n is a, c, g, or t
  misc_feature (1124)..(1124): n is a, c, g, or t
  misc_feature (1128)..(1128): n is a, c, g, or t
tagagaaattactatgagaggatcgcatcaccatcaccatcacggatcctatttaggtgacactatagaatcgtcgacccacgcgtccgcccacgcgtccggtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacacctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttanaccgaganaaaagcaaacaaataaatcacttaatcttgaacactttgccctgtaangaaagtggaaagtcaaacccaccnagctgccttgctgaaancatctccnaggntttgntaggctttgttcaaaancccctgangggggtttgcantccntcnttttntcanngaancccnaacntaattnncntgggnttgntctcccccccnaatttantgtnaaaaaaatttatct

SEQ ID NO: 409 - DNA, 764 bp, Homo sapiens
  misc_feature (2)..(2): n is a, c, g, or t
  misc_feature (4)..(7): n is a, c, g, or t
  misc_feature (9)..(15): n is a, c, g, or t
  misc_feature (442)..(442): n is a, c, g, or t
  misc_feature (464)..(464): n is a, c, g, or t
  misc_feature (469)..(469): n is a, c, g, or t
  misc_feature (509)..(509): n is a, c, g, or t
  misc_feature (516)..(516): n is a, c, g, or t
  misc_feature (527)..(527): n is a, c, g, or t
  misc_feature (537)..(537): n is a, c, g, or t
  misc_feature (541)..(541): n is a, c, g, or t
  misc_feature (556)..(556): n is a, c, g, or t
  misc_feature (579)..(579): n is a, c, g, or t
  misc_feature (581)..(582): n is a, c, g, or t
  misc_feature (596)..(596): n is a, c, g, or t
  misc_feature (619)..(619): n is a, c, g, or t
  misc_feature (635)..(636): n is a, c, g, or t
  misc_feature (638)..(638): n is a, c, g, or t
  misc_feature (678)..(678): n is a, c, g, or t
  misc_feature (681)..(682): n is a, c, g, or t
  misc_feature (687)..(687): n is a, c, g, or t
  misc_feature (694)..(694): n is a, c, g, or t
  misc_feature (706)..(706): n is a, c, g, or t
  misc_feature (725)..(725): n is a, c, g, or t
  misc_feature (730)..(730): n is a, c, g, or t
  misc_feature (738)..(739): n is a, c, g, or t
  misc_feature (742)..(742): n is a, c, g, or t
  misc_feature (745)..(745): n is a, c, g, or t
  misc_feature (752)..(752): n is a, c, g, or t
  misc_feature (762)..(763): n is a, c, g, or t
gncnnnntnnnnnnnattattaagagagaattaactatgagaggatcgcatcaccatcaccatcacggatcctatttaggtgacactatagaatcgtcgacccacgcgtccggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgncttacagcccctttccgagggnatggngcccctacggcccgttggccggccagctcccctgctcagncagcagntatgccgcctnccctggggtntagnagaagttggtaaagnccctccagcccttcagccggccngnntttccaggccctangctccttcctccaatctcccacnaggccccggtttccannangttttggacttttgttcccttccagaaaggccaacaaggnaannttttnacttggncccaaggggaangccttggttttttttccanttccnttcccccnnggntcnggtaaanaaagcccccnna

SEQ ID NO: 410 - DNA, 850 bp, Homo sapiens
  misc_feature (637)..(644): n is a, c, g, or t
  misc_feature (646)..(648): n is a, c, g, or t
  misc_feature (651)..(651): n is a, c, g, or t
  misc_feature (721)..(721): n is a, c, g, or t
  misc_feature (788)..(788): n is a, c, g, or t
  misc_feature (800)..(800): n is a, c, g, or t
  misc_feature (837)..(837): n is a, c, g, or t
agagatactatgagaggatgcatcccatcaccatcacggatcctatttaggtgacactatagaatcgtcgactctggaccttggctgtcactcagttagacaagtaacagctgctcagcttcacctgagggatccagtggcaattgtaaaactagctatttatggtatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaannnnnnnnannnaanaaaaaaaaaacgagcggccgctccctatagtgagtcgtattaagcttaattagctgagcttggactcctngtgatagatccagtaatgaactcagaactccatctgaatttgttcaaaacgctcggttgccgccggncgttttttatgntgaaaatccagctagcttgcgagattttcagagctangaagctaaatgga

SEQ ID NO: 411 - DNA, 1189 bp, Homo sapiens
  misc_feature (1)..(1): n is a, c, g, or t
  misc_feature (876)..(876): n is a, c, g, or t
  misc_feature (892)..(892): n is a, c, g, or t
  misc_feature (925)..(925): n is a, c, g, or t
  misc_feature (946)..(946): n is a, c, g, or t
  misc_feature (954)..(954): n is a, c, g, or t
  misc_feature (956)..(956): n is a, c, g, or t
  misc_feature (977)..(977): n is a, c, g, or t
  misc_feature (988)..(989): n is a, c, g, or t
  misc_feature (993)..(993): n is a, c, g, or t
  misc_feature (996)..(996): n is a, c, g, or t
  misc_feature (999)..(999): n is a, c, g, or t
  misc_feature (1006)..(1006): n is a, c, g, or t
  misc_feature (1008)..(1008): n is a, c, g, or t
  misc_feature (1014)..(1014): n is a, c, g, or t
  misc_feature (1019)..(1019): n is a, c, g, or t
  misc_feature (1030)..(1030): n is a, c, g, or t
  misc_feature (1071)..(1071): n is a, c, g, or t
  misc_feature (1073)..(1073): n is a, c, g, or t
  misc_feature (1082)..(1082): n is a, c, g, or t
  misc_feature (1100)..(1100): n is a, c, g, or t
  misc_feature (1104)..(1104): n is a, c, g, or t
  misc_feature (1109)..(1109): n is a, c, g, or t
  misc_feature (1112)..(1112): n is a, c, g, or t
  misc_feature (1118)..(1118): n is a, c, g, or t
  misc_feature (1125)..(1125): n is a, c, g, or t
  misc_feature (1130)..(1130): n is a, c, g, or t
  misc_feature (1137)..(1137): n is a, c, g, or t
  misc_feature (1142)..(1142): n is a, c, g, or t
  misc_feature (1148)..(1148): n is a, c, g, or t
  misc_feature (1151)..(1153): n is a, c, g, or t
  misc_feature (1161)..(1161): n is a, c, g, or t
  misc_feature (1170)..(1170): n is a, c, g, or t
  misc_feature (1174)..(1174): n is a, c, g, or t
  misc_feature (1176)..(1176): n is a, c, g, or t
naatagagagattactatgagaggatcgcatcaccatcaccatcacggatcctatttaggtgacactatagaatcgtcgacccacgcgtccggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagcccccttaggttggctacaagaacatgcttgctcaagaacttatggtctaggcactcncctgccttgggatgancagtggctgaattgaatcactttctgactcccnctatttacatggcattttacncagttgcncncctattgcaggggggtaactngcatggacagnnaaantcnccnctgggcntnaaaccnccacnagatgacccanggaagtttgggaatatgttttcttcaaggaggctccatttncnaaaaactcnaattgcaaggaaaaattnaatncgttnaancggganttgaatnccggnaaccggntgacnttcccnccnnnggaaagantcttgtccnaacncntttcaaataacct

SEQ ID NO: 412 - DNA, 1375 bp, Homo sapiens
  misc_feature (933)..(933): n is a, c, g, or t
  misc_feature (942)..(942): n is a, c, g, or t
  misc_feature (960)..(960): n is a, c, g, or t
  misc_feature (975)..(975): n is a, c, g, or t
  misc_feature (981)..(981): n is a, c, g, or t
  misc_feature (984)..(984): n is a, c, g, or t
  misc_feature (1017)..(1017): n is a, c, g, or t
  misc_feature (1020)..(1020): n is a, c, g, or t
  misc_feature (1023)..(1023): n is a, c, g, or t
  misc_feature (1025)..(1025): n is a, c, g, or t
  misc_feature (1032)..(1032): n is a, c, g, or t
  misc_feature (1043)..(1043): n is a, c, g, or t
  misc_feature (1066)..(1066): n is a, c, g, or t
  misc_feature (1094)..(1094): n is a, c, g, or t
  misc_feature (1107)..(1108): n is a, c, g, or t
  misc_feature (1115)..(1115): n is a, c, g, or t
  misc_feature (1119)..(1120): n is a, c, g, or t
  misc_feature (1122)..(1122): n is a, c, g, or t
  misc_feature (1143)..(1143): n is a, c, g, or t
  misc_feature (1147)..(1147): n is a, c, g, or t
  misc_feature (1157)..(1158): n is a, c, g, or t
  misc_feature (1177)..(1177): n is a, c, g, or t
  misc_feature (1183)..(1183): n is a, c, g, or t
  misc_feature (1189)..(1189): n is a, c, g, or t
  misc_feature (1192)..(1192): n is a, c, g, or t
  misc_feature (1195)..(1195): n is a, c, g, or t
  misc_feature (1200)..(1200): n is a, c, g, or t
  misc_feature (1202)..(1202): n is a, c, g, or t
  misc_feature (1213)..(1213): n is a, c, g, or t
  misc_feature (1221)..(1221): n is a, c, g, or t
  misc_feature (1223)..(1223): n is a, c, g, or t
  misc_feature (1229)..(1229): n is a, c, g, or t
  misc_feature (1233)..(1233): n is a, c, g, or t
  misc_feature (1240)..(1240): n is a, c, g, or t
  misc_feature (1248)..(1248): n is a, c, g, or t
  misc_feature (1253)..(1253): n is a, c, g, or t
  misc_feature (1255)..(1255): n is a, c, g, or t
  misc_feature (1257)..(1257): n is a, c, g, or t
  misc_feature (1272)..(1272): n is a, c, g, or t
  misc_feature (1278)..(1278): n is a, c, g, or t
  misc_feature (1291)..(1291): n is a, c, g, or t
  misc_feature (1314)..(1314): n is a, c, g, or t
  misc_feature (1317)..(1317): n is a, c, g, or t
  misc_feature (1321)..(1321): n is a, c, g, or t
  misc_feature (1327)..(1327): n is a, c, g, or t
  misc_feature (1329)..(1330): n is a, c, g, or t
  misc_feature (1341)..(1341): n is a, c, g, or t
  misc_feature (1345)..(1345): n is a, c, g, or t
  misc_feature (1358)..(1358): n is a, c, g, or t
  misc_feature (1367)..(1367): n is a, c, g, or t
tagagaaattactatgagaggatcgcatcaccatcaccatcacggatcctatttaggtgacactatagaatcgtcgacccacgcgtccgcccacgcgtccgagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggctgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttaactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacanaaggagccncggtctggaaagtgtgcntgtccttcccgggantggggnagnccggtgtgaattttgatcttccagctcaggcanacnccntnaacaagngcaaacaaaanccgtgttcaaaatgaaagggaancgtaaaccccaaacccgtgcacctaggnggctgggtgctcnnggatccncgcnngnctgagaaatgaacctcccccnaagnacccttgccnngggggctgagggccctttncccaanggcccncgnccnccccncnaaaaaccccgnggaaaaananccctgngagncccggcncccccccnccccntngnaaagggccctgtccngaaggnaaaaacccctttnaaatcctgggttttccaaagggnggngacntttttntnngggaatttttnccgngcgggtttccccngggaaaaancccgggaa

SEQ ID NO: 413 - DNA, 826 bp, Homo sapiens
  misc_feature (714)..(714): n is a, c, g, or t
  misc_feature (747)..(748): n is a, c, g, or t
  misc_feature (784)..(784): n is a, c, g, or t
gatagagagatactatgagaggtcgcatcccatcaccatcacggatcctatttaggtgacactatagaatcgtcgactctggaccttggctgtcactcagttgatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgangaaaactacatgtgtcggaagtttctaaagtannaatctttgtagaaattgtcaaaggggctaatgctancaggctacactcttcctagagtgaaatattttgtgctgcagc

SEQ ID NO: 414 - DNA, 1329 bp, Homo sapiens
atgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctga

SEQ ID NO: 415 - DNA, 1075 bp, Homo sapiens
  misc_feature (674)..(674): n is a, c, g, or t
  misc_feature (683)..(683): n is a, c, g, or t
  misc_feature (720)..(720): n is a, c, g, or t
  misc_feature (733)..(733): n is a, c, g, or t
  misc_feature (807)..(807): n is a, c, g, or t
  misc_feature (813)..(813): n is a, c, g, or t
  misc_feature (815)..(815): n is a, c, g, or t
  misc_feature (817)..(817): n is a, c, g, or t
  misc_feature (824)..(824): n is a, c, g, or t
  misc_feature (833)..(833): n is a, c, g, or t
  misc_feature (836)..(836): n is a, c, g, or t
  misc_feature (853)..(853): n is a, c, g, or t
  misc_feature (866)..(866): n is a, c, g, or t
  misc_feature (874)..(874): n is a, c, g, or t
  misc_feature (878)..(878): n is a, c, g, or t
  misc_feature (886)..(886): n is a, c, g, or t
  misc_feature (911)..(911): n is a, c, g, or t
  misc_feature (914)..(914): n is a, c, g, or t
  misc_feature (919)..(919): n is a, c, g, or t
  misc_feature (924)..(925): n is a, c, g, or t
  misc_feature (935)..(935): n is a, c, g, or t
  misc_feature (946)..(946): n is a, c, g, or t
  misc_feature (951)..(952): n is a, c, g, or t
  misc_feature (958)..(958): n is a, c, g, or t
  misc_feature (966)..(966): n is a, c, g, or t
  misc_feature (968)..(968): n is a, c, g, or t
  misc_feature (973)..(973): n is a, c, g, or t
  misc_feature (977)..(977): n is a, c, g, or t
  misc_feature (999)..(1001): n is a, c, g, or t
  misc_feature (1005)..(1005): n is a, c, g, or t
  misc_feature (1015)..(1015): n is a, c, g, or t
  misc_feature (1017)..(1017): n is a, c, g, or t
  misc_feature (1019)..(1019): n is a, c, g, or t
  misc_feature (1053)..(1053): n is a, c, g, or t
  misc_feature (1055)..(1055): n is a, c, g, or t
  misc_feature (1058)..(1059): n is a, c, g, or t
  misc_feature (1062)..(1062): n is a, c, g, or t
  misc_feature (1066)..(1066): n is a, c, g, or t
  misc_feature (1072)..(1072): n is a, c, g, or t
tagagaaattaactatgagaggatcgcatcaccatcaccatcacggatcctatttaggtgacactatagaatcgtcgacccacgcgtccgcccacgcgtccgggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcanatggtgganagcgtggccggcgccctgggtgtggggctgcgcaagntgtgctggctgcnatccatcggtcaggcggtccagccctgggtggaagccgtgaggtgccaaaacctggggtgtgttttccgggaangaccancnancccccangggaaggantcntttgaagttttggctanaaccacaccaccnaaatgctncatntgtggcanggggttctcgaaaaggaaaaagaanaanaagtnttttnnaaagttttgnttgggaacccnccttnnaatttnttggaaancncttcntggngaaaaaacccccccaggaaagnnncaanaattttttgngngntcctgggcccaatttttttgaaaaaaaaaaattncnaannaanattnggggtnaaa

SEQ ID NO: 416 - DNA, 273 bp, Homo sapiens
atgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctga

SEQ ID NO: 417 - DNA, 1089 bp, Homo sapiens
atggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttga

SEQ ID NO: 418 - DNA, 1311 bp, Homo sapiens
  misc_feature (781)..(781): n is a, c, g, or t
  misc_feature (932)..(932): n is a, c, g, or t
  misc_feature (1283)..(1284): n is a, c, g, or t
atcgacttacctataaataggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaacggccgcgatccgcatgcgagctcgattagctgagcttggactcctgttgatagatccagtaatgacctcagaactccatctggatttgttcaaaacgctcggntgccgccgggcgttttttattggtgagaatccaagctagcttggcgagattttcaggagctaaggaagctaaaatggagaaaaaaatcactggatataccaccgttgatatatcccaatggcatcgtaaagaacattttggagcatttcantcagttgcttcatgtacctataaccaaaccggtcagctggatattacggcccttttaaaaaccgaaaaaaaaataaccacaagttttatccgccctttattccattcctgcccgcctgaaggaagctcacccggaatttctatggcatgaaaaacgggaactgggggaatgggaaaaggttcccccctgttaacccgtttccatagccaacgaaaagtttcctcccctggagggaataaccaaaaattccgcaatttctccctatatcccaaaatgggggggtaggggaaaaccgccatatccccaagggttatgaaaaatgttttccccccccccccgggggagtcccannttgtataaaggggcaaagaaaatgtcg

SEQ ID NO: 419 - DNA, 643 bp, Homo sapiens
  misc_feature (627)..(627): n is a, c, g, or t
gatagagagatactatgagaggtcgcatcaccatcaccatcacggatcctatttaggtgacactatagaatcgtcgactctggaccttggctgtcactcagttgatacagtgacctcgggcggtgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaaatttatatattttgctcatatacatttccatattataattatagaagatgtgtagtctatttagatgttaattanaggaaacaaacaactg

SEQ ID NO: 420 - DNA, 1125 bp, Homo sapiens
atgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctag

SEQ ID NO: 421 - DNA, 351 bp, Homo sapiens
atgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaa

SEQ ID NO: 422 - DNA, 1191 bp, Homo sapiens
  misc_feature (876)..(876): n is a, c, g, or t
  misc_feature (918)..(918): n is a, c, g, or t
  misc_feature (930)..(930): n is a, c, g, or t
  misc_feature (991)..(991): n is a, c, g, or t
  misc_feature (1000)..(1000): n is a, c, g, or t
  misc_feature (1018)..(1018): n is a, c, g, or t
  misc_feature (1025)..(1025): n is a, c, g, or t
  misc_feature (1078)..(1079): n is a, c, g, or t
  misc_feature (1088)..(1088): n is a, c, g, or t
  misc_feature (1099)..(1101): n is a, c, g, or t
  misc_feature (1107)..(1108): n is a, c, g, or t
  misc_feature (1114)..(1114): n is a, c, g, or t
  misc_feature (1116)..(1116): n is a, c, g, or t
  misc_feature (1121)..(1121): n is a, c, g, or t
  misc_feature (1123)..(1123): n is a, c, g, or t
  misc_feature (1134)..(1134): n is a, c, g, or t
  misc_feature (1136)..(1136): n is a, c, g, or t
  misc_feature (1141)..(1141): n is a, c, g, or t
  misc_feature (1148)..(1148): n is a, c, g, or t
  misc_feature (1157)..(1157): n is a, c, g, or t
  misc_feature (1166)..(1166): n is a, c, g, or t
  misc_feature (1170)..(1170): n is a, c, g, or t
  misc_feature (1175)..(1176): n is a, c, g, or t
  misc_feature (1178)..(1178): n is a, c, g, or t
  misc_feature (1180)..(1181): n is a, c, g, or t
gagaaaattactatgagaggatcgcatcaccatcaccatcacggatcctatttaggtgacactatagaatcgtcgacccacgcgtccgcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaatcacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgagccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcanaaggggggcaacatgaaggaggtgttcacccgcttctgcacnggcctcacccanattgaaaactctcttcagtctaaggactatgagttcatgtggaaaccctcacctgggctanatcctcacntgcccatccaacctgggnaccgggntgcgggcaggtgtgcatatcagctgcccaacttggggcaaacatgaaaatttnncggaagtgnttaagcgggtnnnaatttnnaaaacnanggcanangggggggtggnanccggnttggggnggggggggntttttaaantttncaaanntnanncctgggtttt

SEQ ID NO: 423 - DNA, 1092 bp, Homo sapiens
  misc_feature (3)..(3): n is a, c, g, or t
  misc_feature (25)..(25): n is a, c, g, or t
  misc_feature (908)..(908): n is a, c, g, or t
  misc_feature (914)..(914): n is a, c, g, or t
  misc_feature (920)..(920): n is a, c, g, or t
  misc_feature (941)..(941): n is a, c, g, or t
  misc_feature (956)..(957): n is a, c, g, or t
  misc_feature (962)..(962): n is a, c, g, or t
  misc_feature (967)..(967): n is a, c, g, or t
  misc_feature (986)..(986): n is a, c, g, or t
  misc_feature (994)..(995): n is a, c, g, or t
  misc_feature (1019)..(1020): n is a, c, g, or t
  misc_feature (1027)..(1027): n is a, c, g, or t
  misc_feature (1036)..(1036): n is a, c, g, or t
  misc_feature (1045)..(1045): n is a, c, g, or t
  misc_feature (1049)..(1050): n is a, c, g, or t
  misc_feature (1052)..(1052): n is a, c, g, or t
  misc_feature (1054)..(1054): n is a, c, g, or t
  misc_feature (1064)..(1064): n is a, c, g, or t
  misc_feature (1079)..(1079): n is a, c, g, or t
  misc_feature (1081)..(1081): n is a, c, g, or t
  misc_feature (1083)..(1083): n is a, c, g, or t
  misc_feature (1086)..(1086): n is a, c, g, or t
  misc_feature (1090)..(1090): n is a, c, g, or t
atngagaaattactatgagaggatngcatcaccatcaccatcacggatcctatttaggtgacactatagaatcgtcgacccacgcgtccggcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtgcctcatcccatgaaaccctggtgcctggctctttcntcaccnttgganaaaaaaaccaagtcggaacancaaataacaatgcannaaggncctgntgcccaatctccatttgtnaaaggggnntgaggtcccagaagtggccaaaanntaaaaanatcccgttncttaaaatnaaannancntccaaaaaanggttccaaaaactangntnttngaanaa

SEQ ID NO: 424 - DNA, 1006 bp, Homo sapiens
  misc_feature (3)..(3): n is a, c, g, or t
  misc_feature (751)..(751): n is a, c, g, or t
  misc_feature (776)..(776): n is a, c, g, or t
  misc_feature (822)..(822): n is a, c, g, or t
  misc_feature (853)..(853): n is a, c, g, or t
  misc_feature (861)..(861): n is a, c, g, or t
  misc_feature (863)..(864): n is a, c, g, or t
  misc_feature (866)..(866): n is a, c, g, or t
  misc_feature (871)..(871): n is a, c, g, or t
  misc_feature (901)..(901): n is a, c, g, or t
  misc_feature (904)..(904): n is a, c, g, or t
  misc_feature (908)..(908): n is a, c, g, or t
  misc_feature (910)..(910): n is a, c, g, or t
  misc_feature (918)..(918): n is a, c, g, or t
  misc_feature (926)..(926): n is a, c, g, or t
  misc_feature (932)..(932): n is a, c, g, or t
  misc_feature (939)..(939): n is a, c, g, or t
  misc_feature (941)..(941): n is a, c, g, or t
  misc_feature (948)..(948): n is a, c, g, or t
  misc_feature (977)..(977): n is a, c, g, or t
  misc_feature (979)..(979): n is a, c, g, or t
  misc_feature (982)..(982): n is a, c, g, or t
  misc_feature (995)..(995): n is a, c, g, or t
  misc_feature (998)..(998): n is a, c, g, or t
  misc_feature (1001)..(1001): n is a, c, g, or t
  misc_feature (1003)..(1003): n is a, c, g, or t
  misc_feature (1005)..(1005): n is a, c, g, or t
gantagagagattactatgagaggatcgcatcaccatcaccatcacggatcctatttaggtgacactatagaatcgtcgacccacgcgtccgccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcancaagaaggtgtacttcgctgaaaangtgacgtctctgggcaaggattggcaccggccctgcctgcgctgcnagcgctgcgggaaaaacactgaccccccggncgggcacncnnangtgangggggtgcaaacggggcttggggggccggncangggncncggggtcngggggatnaaggtnaaaagcncncctaaanggattggggggtggtgcttctgggaactncnttnccttttcccccanggnaancngnc

SEQ ID NO: 425 - DNA, 1185 bp, Homo sapiens
atacatttaagagggagaattaactatgagaggatcgcatcaccatcaccatcacggatcctatttaggtgacactatagaatcgtcgacccacgcgtccgcccacgcgtccgcccacgcgtccgcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgagtcggggactaattagcctttactcataaagaagagtaggctttttctttttccatatgtcaaattgttgtgtcccaggatgtatagcaggtataaaatagtgaaagaattgttagccttgta

SEQ ID NO: 426 - DNA, 1196 bp, Homo sapiens
  misc_feature (834)..(834): n is a, c, g, or t
  misc_feature (891)..(891): n is a, c, g, or t
  misc_feature (920)..(920): n is a, c, g, or t
  misc_feature (976)..(976): n is a, c, g, or t
  misc_feature (987)..(987): n is a, c, g, or t
  misc_feature (990)..(990): n is a, c, g, or t
  misc_feature (994)..(994): n is a, c, g, or t
  misc_feature (996)..(996): n is a, c, g, or t
  misc_feature (1021)..(1021): n is a, c, g, or t
  misc_feature (1031)..(1032): n is a, c, g, or t
  misc_feature (1034)..(1034): n is a, c, g, or t
  misc_feature (1041)..(1041): n is a, c, g, or t
  misc_feature (1044)..(1045): n is a, c, g, or t
  misc_feature (1053)..(1053): n is a, c, g, or t
  misc_feature (1056)..(1056): n is a, c, g, or t
  misc_feature (1064)..(1064): n is a, c, g, or t
  misc_feature (1078)..(1078): n is a, c, g, or t
  misc_feature (1082)..(1082): n is a, c, g, or t
  misc_feature (1092)..(1092): n is a, c, g, or t
  misc_feature (1097)..(1097): n is a, c, g, or t
  misc_feature (1107)..(1107): n is a, c, g, or t
  misc_feature (1112)..(1112): n is a, c, g, or t
  misc_feature (1120)..(1120): n is a, c, g, or t
  misc_feature (1122)..(1122): n is a, c, g, or t
  misc_feature (1125)..(1127): n is a, c, g, or t
  misc_feature (1134)..(1134): n is a, c, g, or t
  misc_feature (1140)..(1140): n is a, c, g, or t
  misc_feature (1149)..(1149): n is a, c, g, or t
  misc_feature (1157)..(1157): n is a, c, g, or t
  misc_feature (1159)..(1159): n is a, c, g, or t
  misc_feature (1167)..(1167): n is a, c, g, or t
  misc_feature (1169)..(1169): n is a, c, g, or t
  misc_feature (1179)..(1179): n is a, c, g, or t
  misc_feature (1181)..(1181): n is a, c, g, or t
  misc_feature (1196)..(1196): n is a, c, g, or t
tagagaaattactatgagaggatcgcatcaccatcaccatcacggatcctatttaggtgacactatagaatcgtcgacccacgcgtccgagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccntctacggtctcagcagctggccccacagtacacctacgccccaggggcggccagcanacttgggcccccggaaaaggcccctggtngggtgtcaatgggctggatgtgacccagcctgaggccctttgaccttgtcatcccnttcacatcaanaanggcnanatcccaggggaggtttggaatgccntcaggcaagnngngcacccnccnntccttganaanaaaaaggnaccgtggaccgtgnggtntgccccaacnaaggntggcttgccnaaaantggaattncnctnnnaaaaatngcaatnccaagaaancccctttngntttttttngnataacctcantngggcatttcctggcn

SEQ ID NO: 427 - DNA, 1719 bp, Homo sapiens
atggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctga

SEQ ID NO: 428 - DNA, 519 bp, Homo sapiens
cacgcgtccgggtcaagcacaccgggtggtgaaaaagaaaccagcgcaacccagcgtagcagcgttccgagcagcaccgaaaaaaatgcactgagcaccggtgttagcttttttttcctgagctttcatattagcaacctgcagtttaatagcagcctggaagatccgagcaccgattattatcaagaactgcagcgtgatatcagcgaaatgtttctgcagatctataaacagggtggttttctgggtctgagcaacatcaaatttcgtccgggtagcgttgttgttcagctgaccctggcatttcgtgaaggcaccattaatgttcatgatgtggaaacccagtttaaccagtataaaaccgaagcagcaagccgttataatctgaccattagtgatgttagcgtttccgatgttccgtttccgtttagcgcacagagcggtgccggtgttccgggttggtaagcggccgcggtacctggagcacaagactggcctcatgggccttccgctcactgc

SEQ ID NO: 429 - DNA, 1254 bp, Homo sapiens
atgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttag

SEQ ID NO: 430 - DNA, 866 bp, Homo sapiens
  misc_feature (792)..(792): n is a, c, g, or t
tgtaattaagagatacttgagaggatgcatcccatcaccatcacggatcctatttaggtgacactatagaatcgtcgactctggaccttggctgtcactcagttaagaacctgaagaagaattactgtcgtaaccccgatagggagctgcggccttggtgtttcaccaccgaccccaacaagcgctgggaactttgcgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaactttccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgcccgataaggcccctggtgttttaccacagaccccagcgtcaggtgggagtactgcaacctgaaaaaatgctcangaacagaagcgaagtgtgtagccactccgcctggtgtcctggctccagatgtaaagactctttccgagaagact

SEQ ID NO: 431 - DNA, 916 bp, Homo sapiens
tgagaggatcgcatcaccatcaccatcacggatcctatttaggtgacactatagaatcgtcgacccacgcgtccgagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgccc

SEQ ID NO: 432 - DNA, 993 bp, Homo sapiens
  misc_feature (749)..(749): n is a, c, g, or t
  misc_feature (801)..(801): n is a, c, g, or t
  misc_feature (816)..(816): n is a, c, g, or t
  misc_feature (835)..(835): n is a, c, g, or t
  misc_feature (841)..(841): n is a, c, g, or t
  misc_feature (847)..(847): n is a, c, g, or t
  misc_feature (850)..(850): n is a, c, g, or t
  misc_feature (866)..(866): n is a, c, g, or t
  misc_feature (875)..(875): n is a, c, g, or t
  misc_feature (898)..(898): n is a, c, g, or t
  misc_feature (918)..(918): n is a, c, g, or t
  misc_feature (921)..(921): n is a, c, g, or t
  misc_feature (923)..(924): n is a, c, g, or t
  misc_feature (926)..(926): n is a, c, g, or t
  misc_feature (928)..(928): n is a, c, g, or t
  misc_feature (937)..(937): n is a, c, g, or t
  misc_feature (947)..(947): n is a, c, g, or t
  misc_feature (951)..(951): n is a, c, g, or t
  misc_feature (956)..(956): n is a, c, g, or t
  misc_feature (958)..(959): n is a, c, g, or t
  misc_feature (961)..(961): n is a, c, g, or t
  misc_feature (982)..(982): n is a, c, g, or t
  misc_feature (991)..(993): n is a, c, g, or t
aatagagaaattactatgagaggatcgcatcaccatcaccatcacgggatcctatttaggtgacactatagaatcgtcgacccacgcgtccgcttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtanattggttggagtaagaaaaaatgcattgataaatattacaaaactgaatgcnaatgtcctttgtggngcttgttccttgaaaatgnttgggncattcnagngttttgctttcttttnccttataanaaatgacccttttcctccataanttttgatttctaaggaaaanatnannananatttcaaantaaaggtttnaaanggggntnncnttttttttcccctgaaaagantaatttggnnn

SEQ ID NO: 433 - DNA, 816 bp, Homo sapiens
  misc_feature (2)..(2): n is a, c, g, or t
  misc_feature (4)..(4): n is a, c, g, or t
  misc_feature (728)..(728): n is a, c, g, or t
  misc_feature (786)..(786): n is a, c, g, or t
  misc_feature (795)..(795): n is a, c, g, or t
tnanaggagaattaactatgagaggatcgcatcaccatcaccatcacggatcctatttaggtgacactatagaatcgtcgacccacgcgtccgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggnctacaatgcagagacacagaaaactactatgcaagaatgggggaaacgctgctagganccgtgaacntctttgtctctagcatcaaac

SEQ ID NO: 434 - DNA, 950 bp, Homo sapiens
atgagaggtcgcatcaccatcaccatcacggatcctatttaggtgacactatagaatcgtcgacccacgcgtccgcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcgacttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactgggg

SEQ ID NO: 435 - DNA, 1515 bp, Homo sapiens
atggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaa

SEQ ID NO: 436 - DNA, 871 bp, Homo sapiens
  misc_feature (5)..(5): n is a, c, g, or t
  misc_feature (13)..(13): n is a, c, g, or t
  misc_feature (17)..(17): n is a, c, g, or t
  misc_feature (20)..(20): n is a, c, g, or t
  misc_feature (25)..(27): n is a, c, g, or t
  misc_feature (29)..(29): n is a, c, g, or t
  misc_feature (77)..(77): n is a, c, g, or t
  misc_feature (155)..(155): n is a, c, g, or t
  misc_feature (259)..(260): n is a, c, g, or t
  misc_feature (268)..(268): n is a, c, g, or t
  misc_feature (306)..(306): n is a, c, g, or t
  misc_feature (321)..(322): n is a, c, g, or t
  misc_feature (324)..(325): n is a, c, g, or t
  misc_feature (379)..(380): n is a, c, g, or t
  misc_feature (698)..(698): n is a, c, g, or t
  misc_feature (738)..(738): n is a, c, g, or t
  misc_feature (741)..(741): n is a, c, g, or t
  misc_feature (743)..(743): n is a, c, g, or t
  misc_feature (757)..(757): n is a, c, g, or t
  misc_feature (772)..(772): n is a, c, g, or t
  misc_feature (796)..(796): n is a, c, g, or t
  misc_feature (800)..(800): n is a, c, g, or t
  misc_feature (807)..(807): n is a, c, g, or t
  misc_feature (826)..(826): n is a, c, g, or t
  misc_feature (829)..(829): n is a, c, g, or t
  misc_feature (837)..(838): n is a, c, g, or t
  misc_feature (842)..(842): n is a, c, g, or t
  misc_feature (855)..(855): n is a, c, g, or t
  misc_feature (858)..(858): n is a, c, g, or t
  misc_feature (866)..(866): n is a, c, g, or t
aaaancccaattnttanagnggagnnntnactctgagaggatcgcatcaccatcaccatcacggatcctatttaggngacactatagaatcgtcgacccacgcgtccgattttaaatccagctccatacaacgctccgccgccgctgctgccgcnacccggactgcgcgccagcacccccctgccgacagctccgtcactatggaggatatgaacgagtacagcaatatagaggaattcgcagagggatccaagatcanntttttttngaatcagcaggatgacggtaaaatgtttattggagggnggagctgggatacanncnnaaaagatctgacagagtacttgtctcgatttggggaagttgtagactgcacaannaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatgggtacaaaaacaaatgaaaagaagaggattttgttttatcacgtatactgatgaaanagccagcaaaaaaaaatgttagaaagcagataccatcaanttngnttctgggaaggggngaaatcaaagttgcncaccccaaaaaggttttttaggcnggcnaccagcnaccaccaaaaagggggaanagnggctgcanntggngggacaagggggnccnaggggtcngggcc

SEQ ID NO: 437 - DNA, 1191 bp, Homo sapiens
atgttcctgaaggccgtggtcctgaccctggccctggtggctgtcgccggagccagggctgaggtcagtgctgaccaggtggccacagtgatgtgggactacttcagccagctgagcaacaatgccaaggaggccgtggaacatctccagaaatctgaactcacccagcaactcaatgccctcttccaggacaaacttggggaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcaacacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctga

SEQ ID NO: 438 - DNA, 1085 bp, Homo sapiens
  misc_feature (344)..(344): n is a, c, g, or t
  misc_feature (474)..(474): n is a, c, g, or t
  misc_feature (525)..(525): n is a, c, g, or t
  misc_feature (566)..(566): n is a, c, g, or t
  misc_feature (642)..(642): n is a, c, g, or t
  misc_feature (750)..(750): n is a, c, g, or t
  misc_feature (805)..(805): n is a, c, g, or t
  misc_feature (814)..(814): n is a, c, g, or t
  misc_feature (861)..(861): n is a, c, g, or t
  misc_feature (893)..(893): n is a, c, g, or t
  misc_feature (896)..(896): n is a, c, g, or t
  misc_feature (913)..(913): n is a, c, g, or t
  misc_feature (924)..(924): n is a, c, g, or t
  misc_feature (927)..(928): n is a, c, g, or t
  misc_feature (938)..(938): n is a, c, g, or t
  misc_feature (952)..(952): n is a, c, g, or t
  misc_feature (954)..(954): n is a, c, g, or t
  misc_feature (961)..(961): n is a, c, g, or t
  misc_feature (963)..(963): n is a, c, g, or t
  misc_feature (982)..(982): n is a, c, g, or t
  misc_feature (998)..(998): n is a, c, g, or t
  misc_feature (1007)..(1007): n is a, c, g, or t
  misc_feature (1016)..(1016): n is a, c, g, or t
  misc_feature (1019)..(1019): n is a, c, g, or t
  misc_feature (1027)..(1030): n is a, c, g, or t
  misc_feature (1032)..(1032): n is a, c, g, or t
  misc_feature (1042)..(1042): n is a, c, g, or t
  misc_feature (1051)..(1051): n is a, c, g, or t
  misc_feature (1060)..(1060): n is a, c, g, or t
  misc_feature (1074)..(1074): n is a, c, g, or t
  misc_feature (1076)..(1076): n is a, c, g, or t
  misc_feature (1078)..(1080): n is a, c, g, or t
tagagaaattactatgagaggatcgcatcaccatcaccatcacggatcctatttaggtgacactatagaatcgtcgacccacgcgttccgcccacgcgtccgcccacgcgttccgcgccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccnggagggcgtgggcgtggcgccgaagggtcccgggtcttcgacgcctctgcggcggctcctccctccttgcagttggatccctggcgggtgcggcccggcccggcccgtgagcggcgcacagaatgggccnatgctgcttctacacggcggggacgttgtccctgctcctgctggtgaccancgtcacgctgctggtggcccgggtcttccagaaggctgtanaccagagtatcgagaagaaaattgtgttaaggaatggtactgaggcatttgactcctgggagaagccccctctgcntgtgtatactcagttctatttcttcaatgtcaccaatccagaggagatcctcagaggggagacccctcgggtggaaaaaatggggccatacacctacagggaactcanaaacaaagcaaatattcaatttggagataatggaacaacaatatctgctgttaanaacaaaggnctatgtttttgaacgaaaaccaatctgtttggaaaaccctaaaattnaactttaattaaaaaatttaaataattcctgnaantgacttgtcaaaaaaantgggtcccaangtnnactttcctcnagggaaaatcatcnanggcccantntttaaaaagccttattaancaaaaaactttttttntgaaatcanaacaagttnaanaaaatttnnnntnttgggggctnaaaaaaaanaaaaaattnttgtcccctttaancnannnttttt

SEQ ID NO: 439 - DNA, 921 bp, Homo sapiens
atggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctggggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaa

SEQ ID NO: 440 - DNA, 1248 bp, Homo sapiens
atgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaggtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactag

SEQ ID NO: 441 - DNA, 1203 bp, Homo sapiens
  misc_feature (649)..(649): n is a, c, g, or t
  misc_feature (809)..(809): n is a, c, g, or t
  misc_feature (901)..(901): n is a, c, g, or t
  misc_feature (952)..(952): n is a, c, g, or t
  misc_feature (960)..(961): n is a, c, g, or t
  misc_feature (965)..(965): n is a, c, g, or t
  misc_feature (967)..(967): n is a, c, g, or t
  misc_feature (970)..(970): n is a, c, g, or t
  misc_feature (990)..(990): n is a, c, g, or t
  misc_feature (999)..(999): n is a, c, g, or t
  misc_feature (1012)..(1012): n is a, c, g, or t
  misc_feature (1025)..(1025): n is a, c, g, or t
  misc_feature (1032)..(1032): n is a, c, g, or t
  misc_feature (1039)..(1039): n is a, c, g, or t
  misc_feature (1060)..(1060): n is a, c, g, or t
  misc_feature (1097)..(1097): n is a, c, g, or t
  misc_feature (1107)..(1107): n is a, c, g, or t
  misc_feature (1125)..(1125): n is a, c, g, or t
  misc_feature (1132)..(1132): n is a, c, g, or t
  misc_feature (1136)..(1136): n is a, c, g, or t
  misc_feature (1139)..(1139): n is a, c, g, or t
  misc_feature (1144)..(1144): n is a, c, g, or t
  misc_feature (1163)..(1163): n is a, c, g, or t
  misc_feature (1176)..(1176): n is a, c, g, or t
  misc_feature (1179)..(1179): n is a, c, g, or t
  misc_feature (1183)..(1183): n is a, c, g, or t
  misc_feature (1187)..(1187): n is a, c, g, or t
  misc_feature (1189)..(1189): n is a, c, g, or t
  misc_feature (1196)..(1196): n is a, c, g, or t
  misc_feature (1200)..(1200): n is a, c, g, or t
tagagaaaattactatgagaggatcgcatcaccatcaccatcacggaatcctatttaggtgacactatagaatcgtcgacccacgcgtccgtaggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcanagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatganggagctcctggctagaaaagacagcgaaacaggagaaaatattagacaggcagcatcctctcttcagcaggcatcactgaagctgttcgaantggcatacaaaaagatggcatctgaacgagaaggctctggaagttctggcnctggggannaaangnaanatcaaaaggaggaaaaacgntataaatancaaaattttgaancccgaaggacacntatgaanctaggantgaaaaactcctgaacaaaanggggaacttcagccttttacggggttttgcagaatcnaaaaaaattncctaattggaaattaggnccttacnaggntcntttanggacagggattccaaaganaagtcaaaatttngtncccnccgncnttttccngcgngaa

SEQ ID NO: 442 - DNA, 588 bp, Homo sapiens
atggccctcctgttccctctactggcagccctagtgatgaccagctatagccctgttggatctctgggctgtgatctgcctcagaaccatggcctacttagcaggaacaccttggtgcttctgcaccaaatgaggagaatctcccctttcttgtgtctcaaggacagaagagacttcaggttcccccaggagatggtaaaagggagccagttgcagaaggcccatgtcatgtctgtcctccatgagatgctgcagcagatcttcagcctcttccacacagagcgctcctctgctgcctggaacatgaccctcctagaccaactccacactggacttcatcagcaactgcaacacctggagacctgcttgctgcaggtagtgggagaaggagaatctgctggggcaattagcagccctgcactgaccttgaggaggtacttccagggaatccgtgtctacctgaaagagaagaaatacagcgactgtgcctgggaagttgtcagaatggaaatcatgaaatccttgttcttatcaacaaacatgcaagaaagactgagaagtaaagatagagacctgggctcatcttga

SEQ ID NO: 443 - DNA, 1100 bp, Homo sapiens
  misc_feature (855)..(855): n is a, c, g, or t
  misc_feature (972)..(972): n is a, c, g, or t
  misc_feature (996)..(996): n is a, c, g, or t
  misc_feature (998)..(998): n is a, c, g, or t
  misc_feature (1016)..(1016): n is a, c, g, or t
  misc_feature (1022)..(1022): n is a, c, g, or t
  misc_feature (1024)..(1024): n is a, c, g, or t
  misc_feature (1027)..(1027): n is a, c, g, or t
  misc_feature (1037)..(1037): n is a, c, g, or t
  misc_feature (1063)..(1063): n is a, c, g, or t
  misc_feature (1084)..(1084): n is a, c, g, or t
  misc_feature (1087)..(1087): n is a, c, g, or t
  misc_feature (1094)..(1094): n is a, c, g, or t
  misc_feature (1100)..(1100): n is a, c, g, or t
agagaaattactatgagaggatcgcatcaccatcaccatcacggatcctatttaggtgacactatagaatcgtcgacccacgcgtccgtgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggacatggtatcaagcagtcattcaatgactataacctctactcccttgggattgtagaattataacttttaaaaaaaatgtataanttatacctggcctgtacagctgtttcctacctactcttcttgtaaactctgctgcttcccaacacaactagagtgcattttggcatcttaggagggaaaaggacagtttacaactgnggccctatttattacccagtttgncnatcgggcctaaatttagncttacngngcnagctactgtncctaaaggacggacttttggattttngggaggttatttttaaccccnttnaataccnaccgcn

SEQ ID NO: 444 - DNA, 1169 bp, Homo sapiens
  misc_feature (922)..(922): n is a, c, g, or t
  misc_feature (933)..(933): n is a, c, g, or t
  misc_feature (955)..(955): n is a, c, g, or t
  misc_feature (961)..(961): n is a, c, g, or t
  misc_feature (982)..(982): n is a, c, g, or t
  misc_feature (997)..(997): n is a, c, g, or t
  misc_feature (1003)..(1003): n is a, c, g, or t
  misc_feature (1005)..(1005): n is a, c, g, or t
  misc_feature (1012)..(1012): n is a, c, g, or t
  misc_feature (1022)..(1022): n is a, c, g, or t
  misc_feature (1030)..(1030): n is a, c, g, or t
  misc_feature (1032)..(1032): n is a, c, g, or t
  misc_feature (1053)..(1053): n is a, c, g, or t
  misc_feature (1074)..(1075): n is a, c, g, or t
  misc_feature (1084)..(1084): n is a, c, g, or t
  misc_feature (1088)..(1088): n is a, c, g, or t
  misc_feature (1098)..(1098): n is a, c, g, or t
  misc_feature (1101)..(1101): n is a, c, g, or t
  misc_feature (1108)..(1108): n is a, c, g, or t
  misc_feature (1111)..(1111): n is a, c, g, or t
  misc_feature (1126)..(1128): n is a, c, g, or t
  misc_feature (1131)..(1132): n is a, c, g, or t
  misc_feature (1138)..(1138): n is a, c, g, or t
  misc_feature (1142)..(1142): n is a, c, g, or t
  misc_feature (1145)..(1145): n is a, c, g, or t
  misc_feature (1148)..(1148): n is a, c, g, or t
  misc_feature (1162)..(1163): n is a, c, g, or t
  misc_feature (1165)..(1165): n is a, c, g, or t
  misc_feature (1168)..(1168): n is a, c, g, or t
tagagaaaattactatgagaggatcgcatcaccatcaccatcacggatcctatttaggtgacactatagaatcgtcgacccacgcgtccgggcccttgctcatcaccttcaccccagccactgaccccagcgacctctggaaggatgggcagcagcagccacagcccgagaagccagagtccaccctggatggggctgcagccctagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgtgagaactgtgacacccacttccaagattccaaccaccgcacatccactgctcacctgctgtcactgtcgcagggtcctcaccctcccaaccttccacttggggtgcccatctccagcccgggcttcaactgctgctgaagggggggctgggaaccagaatgggggctgggaaccccgggggtganggccgtgccantcccatccccactgtcctcaanaggganccaggaaagaactaggctacngatcaccccccccancccccnantgaaacntttttcccancttggganancccaaacttgtggctgggaanggaaaaaaccccccctcgggnnggccccccntgancttggagggnagnaaaaaanganggaaagaaaaaaaannnggnnttgggnaacnggnttntaaggactttactnnanccnc

SEQ ID NO: 445 - DNA, 623 bp, Homo sapiens
  misc_feature (623)..(623): n is a, c, g, or t
tagagagatactatgagaggacgcatcaccatcaccatcacggatcctatttaggtgacactatagaatcgtcgactctggaccttggctgtcactcagttatcactgtcatgtctggtcgtggcaagcaaggaggcaaggcccgcgccaaggccaagtcgcgctcgtcccgcgctggccttcagttcccggtagggcgagtgcatcgcttgctgcgcaaaggcagctacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctgan

SEQ ID NO: 446 - DNA, 1179 bp, Homo sapiens
  misc_feature (2)..(2): n is a, c, g, or t
  misc_feature (6)..(6): n is a, c, g, or t
  misc_feature (479)..(479): n is a, c, g, or t
  misc_feature (944)..(944): n is a, c, g, or t
  misc_feature (985)..(985): n is a, c, g, or t
  misc_feature (992)..(992): n is a, c, g, or t
  misc_feature (1015)..(1015): n is a, c, g, or t
  misc_feature (1051)..(1051): n is a, c, g, or t
  misc_feature (1054)..(1054): n is a, c, g, or t
  misc_feature (1056)..(1056): n is a, c, g, or t
  misc_feature (1066)..(1066): n is a, c, g, or t
  misc_feature (1074)..(1074): n is a, c, g, or t
  misc_feature (1094)..(1094): n is a, c, g, or t
  misc_feature (1100)..(1100): n is a, c, g, or t
  misc_feature (1107)..(1107): n is a, c, g, or t
  misc_feature (1110)..(1110): n is a, c, g, or t
  misc_feature (1116)..(1116): n is a, c, g, or t
  misc_feature (1121)..(1121): n is a, c, g, or t
  misc_feature (1128)..(1128): n is a, c, g, or t
  misc_feature (1132)..(1132): n is a, c, g, or t
  misc_feature (1145)..(1145): n is a, c, g, or t
  misc_feature (1150)..(1150): n is a, c, g, or t
  misc_feature (1153)..(1153): n is a, c, g, or t
  misc_feature (1169)..(1169): n is a, c, g, or t
  misc_feature (1172)..(1172): n is a, c, g, or t
anaatngagaaattactatgagaggatcgcatcaccatcaccatcacggatcctatttaggtgacactatagaatcgtcgacccacgcgtccgcggacgcgtgggtggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccanaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgctttcctccnaaaggcgctctttctgcatcgagccttccacctggccctgntgactgnccacctcaccctgctcctgctgntttgccctctgcaggtggcacaggaaaggggaaaanttntngtccctgctnaaggaatncctccaaaaggaaggttccnccccanccccttnaancccaanccatnttccttnaaantttggggaaaggnaaatnttngccctcctctaagggnctnaaaaaaa

SEQ ID NO: 447 - DNA, 1293 bp, Homo sapiens
  misc_feature (1)..(1): n is a, c, g, or t
  misc_feature (13)..(13): n is a, c, g, or t
nccgccccttcgnctaagaattactagagaggacgcatcaccatcaccatcacggtcgacccacgcgtccggacagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattcccccagttttttatgggaggaaaaaaagctttaatggtgagcatgctgcgagctgctgcgtggaaaggcctctgtatgggccgaagaccctttctccctggctgccaggctcgccaggagcccactgggaacgcccaacacgggggctcctgttacacatggtctttttttatccgatcaacctgtgcacttttgaaatttgaaataaatttgcttcccctaatccccgcgaaaagacggctccggtgccggggccaatgctccgggccctgaacttggcgcctcacctccccccggtttttctgggggcacccccaagcaaaaaatgtgggccccaaagggggagccttaaaccccaaaaaaggggctttccccccgaggggccccctaatggtttccccctg

SEQ ID NO: 448 - DNA, 1403 bp, Homo sapiens
  misc_feature (1)..(2): n is a, c, g, or t
  misc_feature (13)..(15): n is a, c, g, or t
  misc_feature (873)..(873): n is a, c, g, or t
  misc_feature (956)..(957): n is a, c, g, or t
  misc_feature (993)..(993): n is a, c, g, or t
  misc_feature (998)..(999): n is a, c, g, or t
  misc_feature (1003)..(1003): n is a, c, g, or t
  misc_feature (1012)..(1015): n is a, c, g, or t
  misc_feature (1027)..(1032): n is a, c, g, or t
nncgactatcgtnnnccaagagatactatagaggatgcatcaccatcaccatcacggtcgacccacgcgtccgcccacgcgtccggagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagntaaatatacttggaaataagcagttctccgaactgtagtatttccttctcactaccttgtacctttatacttagattgaattnnctaataaataaaattatatgaaattttcaaaaaaanaaaannaaanaaaaaaaannnnaaaaaaaaaaannnnnnaaggggggccgctgcaagacctcgcgccgactcgcgacggagaacgcttgcacgccagaaagtccctctatggctgctgaacggctctgaaccaacaacccccctcggctcggaacaaatcccaaaacgaaaggagtgaatggcaaaccatgatgccctgaacacggggcttccccaagaacaagggttgccctccccgccccccggggggtggggaattcccacccctccacccaaaaaaaccccacgcttcacgcctaggggaacatacaacgggggaaaaattcccacccttttttttggtgccccatttaaaaccccccccctcctccccccattaaaaccatattcccccgctacggagaccttca

SEQ ID NO: 449 - DNA, 846 bp, Homo sapiens
  misc_feature (2)..(2): n is a, c, g, or t
  misc_feature (811)..(811): n is a, c, g, or t
  misc_feature (837)..(837): n is a, c, g, or t
  misc_feature (845)..(845): n is a, c, g, or t
tnagaggagaaattaactatgagaggatcgcatcaccatcaccatcacggatcctatttaggtgacactatagaatcgtcgacccacgcgtccggcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgggccttccanatggctgggagatgcctctgtggggnatgaaaang

SEQ ID NO: 450 - DNA, 557 bp, Homo sapiens
ccattaagaaggaagaattaactatgagaggtcgcatcaccatcaccatcacggatcctatttaggtgacactatagaatcgtcgacccacgcgtccgcccacgcgtccgcccacgcgtccgcccacgcgtccggcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatgggg

SEQ ID NO: 451 - DNA, 1083 bp, Homo sapiens
atgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaacctcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctag

SEQ ID NO: 452 - DNA, 1662 bp, Homo sapiens
atgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaa

SEQ ID NO: 453 - DNA, 1590 bp, Homo sapiens
atgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtga

SEQ ID NO: 454 - DNA, 1125 bp, Homo sapiens
  misc_feature (232)..(232): n is a, c, g, or t
  misc_feature (475)..(475): n is a, c, g, or t
  misc_feature (553)..(553): n is a, c, g, or t
  misc_feature (596)..(596): n is a, c, g, or t
  misc_feature (608)..(608): n is a, c, g, or t
  misc_feature (635)..(635): n is a, c, g, or t
  misc_feature (649)..(649): n is a, c, g, or t
  misc_feature (657)..(657): n is a, c, g, or t
  misc_feature (715)..(715): n is a, c, g, or t
  misc_feature (730)..(730): n is a, c, g, or t
  misc_feature (735)..(735): n is a, c, g, or t
  misc_feature (747)..(747): n is a, c, g, or t
  misc_feature (752)..(752): n is a, c, g, or t
  misc_feature (765)..(766): n is a, c, g, or t
  misc_feature (779)..(779): n is a, c, g, or t
  misc_feature (787)..(788): n is a, c, g, or t
  misc_feature (827)..(828): n is a, c, g, or t
  misc_feature (843)..(843): n is a, c, g, or t
  misc_feature (845)..(845): n is a, c, g, or t
  misc_feature (861)..(861): n is a, c, g, or t
  misc_feature (882)..(882): n is a, c, g, or t
  misc_feature (886)..(886): n is a, c, g, or t
  misc_feature (889)..(889): n is a, c, g, or t
  misc_feature (899)..(900): n is a, c, g, or t
  misc_feature (908)..(909): n is a, c, g, or t
  misc_feature (911)..(913): n is a, c, g, or t
  misc_feature (929)..(929): n is a, c, g, or t
  misc_feature (933)..(933): n is a, c, g, or t
  misc_feature (942)..(942): n is a, c, g, or t
  misc_feature (948)..(948): n is a, c, g, or t
  misc_feature (956)..(957): n is a, c, g, or t
  misc_feature (970)..(970): n is a, c, g, or t
  misc_feature (976)..(976): n is a, c, g, or t
  misc_feature (985)..(986): n is a, c, g, or t
  misc_feature (991)..(991): n is a, c, g, or t
  misc_feature (1001)..(1001): n is a, c, g, or t
  misc_feature (1006)..(1006): n is a, c, g, or t
  misc_feature (1008)..(1008): n is a, c, g, or t
  misc_feature (1016)..(1016): n is a, c, g, or t
  misc_feature (1024)..(1024): n is a, c, g, or t
  misc_feature (1032)..(1032): n is a, c, g, or t
  misc_feature (1041)..(1042): n is a, c, g, or t
  misc_feature (1049)..(1050): n is a, c, g, or t
  misc_feature (1052)..(1052): n is a, c, g, or t
  misc_feature (1054)..(1054): n is a, c, g, or t
  misc_feature (1065)..(1065): n is a, c, g, or t
  misc_feature (1067)..(1067): n is a, c, g, or t
  misc_feature (1075)..(1075): n is a, c, g, or t
  misc_feature (1078)..(1078): n is a, c, g, or t
  misc_feature (1090)..(1090): n is a, c, g, or t
  misc_feature (1094)..(1094): n is a, c, g, or t
  misc_feature (1104)..(1105): n is a, c, g, or t
  misc_feature (1116)..(1117): n is a, c, g, or t
gaatagagagattactatgagaggatcgcatcaccatcaccatcacggatcctatttaggtgacactatagaatcgtcgacccacgcgtccgggtttggttgtgagatcgagaataacagaagcagcggagcattctggaaatattactatgatggaaaggactacattgaattcaacaaagaaatcccagcctgggtccccttcgacccagcagcccagataaccaagcanaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggancctgagttacggggagatgttcttcacaatggaaatggcacttaccagtcctgggtggtggtggcagtgcccccgcangacacagccccctactcctgccacgtgcagcacagcagcctgncccagcccctcntggtgccctgggaggccagctaggaancaagggttggaggnaatgtggnatctcaaacccagtaagctgcccttcctgcctgatgtgggagctgaaccacagaaatncacatgtcaatgganccacnaggccctgaagnagcantgtgggggggacnnaacaggaggttgnatttggannaccgaaagactgggatgcctgtcttgaagtataacttgnnacccaaaaaaaatcntntcacccttgagccccncccccaccccccttggtctantctngtnagaagctaannaaaataanncnnnccctcctttccctaancaanaaaaatgantaatanactaaaannttattttctactnagggcnggccccccnnccatnaaggagtccncaatnanatcttaantcaccttnatctttgncaccctgtnnaaaaaanncncnaaattgactcncnaacctccnttncgaattgttttnaaanactctcgttnngccccggcgtnnattttttt

SEQ ID NO: 455 - DNA, 1400 bp, Homo sapiens
  misc_feature (1)..(3): n is a, c, g, or t
  misc_feature (1022)..(1022): n is a, c, g, or t
  misc_feature (1119)..(1119): n is a, c, g, or t
  misc_feature (1128)..(1128): n is a, c, g, or t
  misc_feature (1179)..(1179): n is a, c, g, or t
  misc_feature (1198)..(1198): n is a, c, g, or t
  misc_feature (1212)..(1212): n is a, c, g, or t
  misc_feature (1217)..(1217): n is a, c, g, or t
  misc_feature (1220)..(1221): n is a, c, g, or t
  misc_feature (1243)..(1243): n is a, c, g, or t
  misc_feature (1266)..(1266): n is a, c, g, or t
  misc_feature (1278)..(1280): n is a, c, g, or t
  misc_feature (1355)..(1355): n is a, c, g, or t
  misc_feature (1368)..(1368): n is a, c, g, or t
  misc_feature (1371)..(1371): n is a, c, g, or t
  misc_feature (1394)..(1394): n is a, c, g, or t
  misc_feature (1396)..(1396): n is a, c, g, or t
nnnggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggccgcggccgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttaacatggggcaactgctgctgcagcacggcgccaacctgaacgcgcaaatggacttccggcagctccgccctgcactcaagcgtccggccgccgggctccctcccgctgggggcgcacgcgggtcccccaacgggcctaaaaaaaaaccctcaaaaaattggcccaacaaacacccgccctaatggggggggcccaacccccaagggcaactcaacaatctgaaaggggaaaagcccccacnagccgggtctacaccacggacagacataacgccaagaaaccctcaaaaagccaactccagcgacccccttagaaaaaaccacacgacaacagccaanaaccccccncgcgaccatataaacccaacgccagcaatacccgccccccaccaattatangtacacaaacacccccaanccacaaccacaccnaaacncannaaacccaccacaaacacaacanacccccaaaacaacacaccaccncacactcaaacnnntcaaacgcccacacatacacaccaaaaaccacaaacaacacggcttcacgacccgaacaacaaccacccaccacncataacccaaatnacncacacacaataaacaacacccanancaca

SEQ ID NO: 456 - DNA, 1437 bp, Homo sapiens
  misc_feature (1)..(2): n is a, c, g, or t
  misc_feature (14)..(14): n is a, c, g, or t
  misc_feature (16)..(16): n is a, c, g, or t
  misc_feature (1376)..(1376): n is a, c, g, or t
nnccgcaccccccncnctaagaattactagagaggatcgcatcaccatcaccatcacggtcgacccacgcgtccgcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgcccaggtgtccaagaacagtgagacattccccacaatccttgaggaagccaaaggagtggttggccgtgcagctaatgtgggtcctgtgaccgcggcagctcctcagcggagccgcagactgtcctgccctgcagcatgtgcctaaaggctcaaggggaatcccctcctggggtggcacttcccaccacccgaccctgtctttctctctgggccgctgctctctcaacatcacatacagcttccactggctggagggcaaaaaggaaaggccagtgccacggaaagcctgaacccgaacttaccaaccccggtttgttctattaccaaccaagcccccaggttcctaccctaaccctctccccatcctgaaccccaaacaacctcactcctaccagcgccccccgctccttctcatcctcagctttacatgggcttctccaccccccccaacctacctccctaagcaccctccacatctctcaaacccactaaccaactttactccccatccaccacttcttacaccccctccacctggactttccactctccattctaactcgtcaccaccacatnctcatcaccttctcgacccccacgccacgccacccacaccacacccaattacacacttcca

SEQ ID NO: 457 - DNA, 1182 bp, Homo sapiens
  misc_feature (1)..(2): n is a, c, g, or t
  misc_feature (913)..(913): n is a, c, g, or t
  misc_feature (915)..(928): n is a, c, g, or t
  misc_feature (930)..(935): n is a, c, g, or t
  misc_feature (960)..(960): n is a, c, g, or t
  misc_feature (973)..(975): n is a, c, g, or t
  misc_feature (999)..(999): n is a, c, g, or t
  misc_feature (1006)..(1006): n is a, c, g, or t
  misc_feature (1026)..(1026): n is a, c, g, or t
  misc_feature (1044)..(1044): n is a, c, g, or t
  misc_feature (1046)..(1046): n is a, c, g, or t
  misc_feature (1051)..(1051): n is a, c, g, or t
  misc_feature (1055)..(1055): n is a, c, g, or t
  misc_feature (1058)..(1058): n is a, c, g, or t
  misc_feature (1070)..(1070): n is a, c, g, or t
  misc_feature (1078)..(1078): n is a, c, g, or t
  misc_feature (1083)..(1083): n is a, c, g, or t
  misc_feature (1113)..(1113): n is a, c, g, or t
  misc_feature (1128)..(1128): n is a, c, g, or t
  misc_feature (1132)..(1132): n is a, c, g, or t
  misc_feature (1135)..(1135): n is a, c, g, or t
  misc_feature (1137)..(1137): n is a, c, g, or t
  misc_feature (1159)..(1161): n is a, c, g, or t
  misc_feature (1166)..(1166): n is a, c, g, or t
nnattagagaaattactatgagaggatcgcatcaccatcaccatcacggatcctatttaggtgacactatagaatcgtcgacccacgcgtccgcctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaaaaanannnnnnnnnnnnnnannnnnnaaaagggggggccgctccctatagngagtcgtattaannnttaattacctgaacttggaactcnggttganaaatccagtaatgacccccnaaactccctctggatttntncaaancccncgnttgcccccgggngttttttnttggngaaaatccaagctagctgggcgaaaatttncgggaactaaggaangctnaantngggaaaaaaaatccctgggaannnccccngtttaatttcccatgg

SEQ ID NO: 458 - DNA, 1171 bp, Homo sapiens
  misc_feature (810)..(810): n is a, c, g, or t
  misc_feature (948)..(948): n is a, c, g, or t
  misc_feature (966)..(966): n is a, c, g, or t
  misc_feature (969)..(969): n is a, c, g, or t
  misc_feature (988)..(988): n is a, c, g, or t
  misc_feature (997)..(997): n is a, c, g, or t
  misc_feature (1009)..(1009): n is a, c, g, or t
  misc_feature (1022)..(1022): n is a, c, g, or t
  misc_feature (1029)..(1029): n is a, c, g, or t
  misc_feature (1045)..(1045): n is a, c, g, or t
  misc_feature (1054)..(1054): n is a, c, g, or t
  misc_feature (1056)..(1056): n is a, c, g, or t
  misc_feature (1067)..(1067): n is a, c, g, or t
  misc_feature (1078)..(1078): n is a, c, g, or t
  misc_feature (1092)..(1092): n is a, c, g, or t
  misc_feature (1109)..(1109): n is a, c, g, or t
  misc_feature (1113)..(1113): n is a, c, g, or t
  misc_feature (1121)..(1121): n is a, c, g, or t
  misc_feature (1124)..(1124): n is a, c, g, or t
  misc_feature (1128)..(1128): n is a, c, g, or t
  misc_feature (1138)..(1138): n is a, c, g, or t
  misc_feature (1145)..(1145): n is a, c, g, or t
  misc_feature (1153)..(1153): n is a, c, g, or t
  misc_feature (1165)..(1165): n is a, c, g, or t
  misc_feature (1171)..(1171): n is a, c, g, or t
attagagaaattactatgagaggatcgcatcaccatcaccatcacggatcctatttaggtgacactatagaatcgtcgacccacgcgtccgggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaangaagagttgaccctggagggtatccgccagttctacatcaacgtggaacgagaggagtggaagctggacacactatgtgacttgtatgaaaccctgaccatcacccaggcagtcatcttcatcaacacccggaggaangtggactggctcaccganaanatgcatgctcgaaatttcnctgtatccnccatgcatgganatatggaccaaangaacganacgtgattatgagggntttcgttcngnctctaccaaanttttgattacnctgacctgctggcnaaagcattgatgtgcancagnttttttantcntcanctaagacctncccccanagggaaantatttcccaaantcgtcn

SEQ ID NO: 459 - DNA, 1280 bp, Homo sapiens
  misc_feature (823)..(823): n is a, c, g, or t
  misc_feature (861)..(861): n is a, c, g, or t
  misc_feature (893)..(893): n is a, c, g, or t
  misc_feature (939)..(939): n is a, c, g, or t
  misc_feature (945)..(945): n is a, c, g, or t
  misc_feature (947)..(947): n is a, c, g, or t
  misc_feature (949)..(949): n is a, c, g, or t
  misc_feature (966)..(966): n is a, c, g, or t
  misc_feature (973)..(973): n is a, c, g, or t
  misc_feature (979)..(979): n is a, c, g, or t
  misc_feature (983)..(984): n is a, c, g, or t
  misc_feature (991)..(991): n is a, c, g, or t
  misc_feature (1002)..(1002): n is a, c, g, or t
  misc_feature (1027)..(1028): n is a, c, g, or t
  misc_feature (1031)..(1031): n is a, c, g, or t
  misc_feature (1051)..(1051): n is a, c, g, or t
  misc_feature (1057)..(1057): n is a, c, g, or t
  misc_feature (1066)..(1066): n is a, c, g, or t
  misc_feature (1072)..(1072): n is a, c, g, or t
  misc_feature (1076)..(1076): n is a, c, g, or t
  misc_feature (1087)..(1087): n is a, c, g, or t
  misc_feature (1090)..(1090): n is a, c, g, or t
  misc_feature (1094)..(1094): n is a, c, g, or t
  misc_feature (1101)..(1101): n is a, c, g, or t
  misc_feature (1106)..(1106): n is a, c, g, or t
  misc_feature (1109)..(1109): n is a, c, g, or t
  misc_feature (1123)..(1123): n is a, c, g, or t
  misc_feature (1125)..(1126): n is a, c, g, or t
  misc_feature (1128)..(1128): n is a, c, g, or t
  misc_feature (1133)..(1133): n is a, c, g, or t
  misc_feature (1138)..(1138): n is a, c, g, or t
  misc_feature (1140)..(1141): n is a, c, g, or t
  misc_feature (1147)..(1147): n is a, c, g, or t
  misc_feature (1156)..(1156): n is a, c, g, or t
  misc_feature (1158)..(1158): n is a, c, g, or t
  misc_feature (1161)..(1161): n is a, c, g, or t
  misc_feature (1184)..(1184): n is a, c, g, or t
  misc_feature (1188)..(1188): n is a, c, g, or t
  misc_feature (1194)..(1194): n is a, c, g, or t
  misc_feature (1202)..(1202): n is a, c, g, or t
  misc_feature (1204)..(1204): n is a, c, g, or t
  misc_feature (1214)..(1214): n is a, c, g, or t
  misc_feature (1225)..(1226): n is a, c, g, or t
  misc_feature (1249)..(1249): n is a, c, g, or t
  misc_feature (1256)..(1256): n is a, c, g, or t
  misc_feature (1279)..(1280): n is a, c, g, or t
tagagagattactatgagaggatcgcatcaccatcaccatcacggatcctatttaggtgacactatagaatcgtcgacccacgcgtccgcccacgcgtccgaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccgtggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggntcaaagtattaacagcacaagtggtaagttaacattanaataggaattggtgtttgggggggggggtttngcaaagaaaaattttattttaatttttttggaaggaaatttttaanctaatnananattaaaacatttcttgnctgctgngctgcnaaannccataancaaaattttanggcccttgtttgaagaactgaaatnnctntcccaagtttgaaaaaaatntttttnggtttaaantaaaancccntaccttaaaantgnaggnggggaanggggnaanaaccttttgccttnannanttccnacccnannctcccntttaaaccntncgncttttaaaaaaaaattatgtttncttncaatgngggaaacntnaaggattttntccttgggccnncagggacctttgaaacctttttngtgggcnttttttttttccccggggttttnn

SEQ ID NO: 460 - DNA, 552 bp, Homo sapiens
atgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggaaccagactgtgatgactgggagagcgggcagaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaa

SEQ ID NO: 461 - DNA, 1008 bp, Homo sapiens
atggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgacgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatggcctccaaggagtaa

SEQ ID NO: 462 - DNA, 1050 bp, Homo sapiens
atggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtga

SEQ ID NO: 463 - DNA, 1227 bp, Homo sapiens
  misc_feature (966)..(966): n is a, c, g, or t
  misc_feature (968)..(968): n is a, c, g, or t
  misc_feature (970)..(970): n is a, c, g, or t
  misc_feature (975)..(975): n is a, c, g, or t
  misc_feature (977)..(977): n is a, c, g, or t
  misc_feature (1007)..(1007): n is a, c, g, or t
  misc_feature (1010)..(1010): n is a, c, g, or t
  misc_feature (1017)..(1017): n is a, c, g, or t
  misc_feature (1031)..(1031): n is a, c, g, or t
  misc_feature (1065)..(1065): n is a, c, g, or t
  misc_feature (1071)..(1071): n is a, c, g, or t
  misc_feature (1089)..(1089): n is a, c, g, or t
  misc_feature (1094)..(1094): n is a, c, g, or t
  misc_feature (1100)..(1100): n is a, c, g, or t
  misc_feature (1111)..(1111): n is a, c, g, or t
  misc_feature (1113)..(1113): n is a, c, g, or t
  misc_feature (1115)..(1115): n is a, c, g, or t
  misc_feature (1132)..(1132): n is a, c, g, or t
  misc_feature (1134)..(1134): n is a, c, g, or t
  misc_feature (1153)..(1153): n is a, c, g, or t
  misc_feature (1168)..(1168): n is a, c, g, or t
  misc_feature (1170)..(1170): n is a, c, g, or t
  misc_feature (1182)..(1183): n is a, c, g, or t
  misc_feature (1191)..(1191): n is a, c, g, or t
  misc_feature (1201)..(1201): n is a, c, g, or t
  misc_feature (1204)..(1204): n is a, c, g, or t
  misc_feature (1209)..(1209): n is a, c, g, or t
  misc_feature (1214)..(1215): n is a, c, g, or t
  misc_feature (1220)..(1220): n is a, c, g, or t
  misc_feature (1225)..(1225): n is a, c, g, or t
  misc_feature (1227)..(1227): n is a, c, g, or t
atagagaaattactatgagaggatcgcatcaccatcaccatcacggatcctatttaggtgacactatagaatcgtcgacccacgcgtccggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcagttaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaaaacaccctctgagggcgggnancntccanantacctttgtatttgaggaaataggaccccnccnaaagganattgggcctgaggnggtgaaaaaagtaaatgctgtatttgagtggcanaaaccnaaggcggaaaaattgggnctaanggacantgacctgaaangngntctggaaaatgtaccangncccgcaaagggctgctgancaacaatccaacttncnaaaaaaaattcnngggggggnccgggcaacntgnccccnaaggnnttttntggcngn

SEQ ID NO: 464 - DNA, 1926 bp, Homo sapiens
atggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccttgatgaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcgccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaa

SEQ ID NO: 465 - DNA, 1941 bp, Homo sapiens
atgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgccgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaa

SEQ ID NO: 466 - DNA, 979 bp, Homo sapiens
taactatgagaggatcgcatcaccatcaccatcacggatcctatttaggtgacactatagaatcgtcgacccacgcgtccgccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcga

SEQ ID NO: 467 - DNA, 1190 bp, Homo sapiens
  misc_feature (1)..(2): n is a, c, g, or t
  misc_feature (14)..(14): n is a, c, g, or t
  misc_feature (981)..(981): n is a, c, g, or t
  misc_feature (1036)..(1037): n is a, c, g, or t
  misc_feature (1101)..(1101): n is a, c, g, or t
  misc_feature (1109)..(1110): n is a, c, g, or t
  misc_feature (1134)..(1134): n is a, c, g, or t
  misc_feature (1137)..(1137): n is a, c, g, or t
  misc_feature (1141)..(1141): n is a, c, g, or t
  misc_feature (1155)..(1155): n is a, c, g, or t
  misc_feature (1160)..(1160): n is a, c, g, or t
  misc_feature (1164)..(1166): n is a, c, g, or t
  misc_feature (1171)..(1171): n is a, c, g, or t
  misc_feature (1174)..(1178): n is a, c, g, or t
  misc_feature (1184)..(1184): n is a, c, g, or t
  misc_feature (1189)..(1189): n is a, c, g, or t
nncccgttcttccnctaagagatactagagaggatcgcatcaccatcacatcacggtcgacccacgcgtccgcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccgggggtggggtggctgcagcctcaggactgggagcccccagcctgtcagatccaggagctccagtgtcctgagctcagcgtggaggggtaggggctgggaacagggtgcaaggaagccgggggccccacccccgggggagtggcctgaccctgcaattggcaccaagcccaaagggccggtggcccaaaaatgaccccagggtataaaaagtgtattttcctccaaagggattttgtttttccctccagggccgggggcccccagggatttctggggtggaacactccccaaaaacggggaaaacccccaccccctaacatgtnaggaaaacccccgactcccccccaagaacccgggagtaccccaccgccctttccnnaaaaaggcccaacttcccccccatttcccaaagggaaaacctcctggccccgcccactcccccncgggcccnnggcaaccgccccctcccccacccnccncacnccccccctctcccnccccngggnnntcccnccnnnnnagccgnccccnc

SEQ ID NO: 468 - DNA, 1253 bp, Homo sapiens
  misc_feature (945)..(945): n is a, c, g, or t
  misc_feature (957)..(957): n is a, c, g, or t
  misc_feature (962)..(962): n is a, c, g, or t
  misc_feature (983)..(983): n is a, c, g, or t
  misc_feature (1008)..(1008): n is a, c, g, or t
  misc_feature (1012)..(1012): n is a, c, g, or t
  misc_feature (1018)..(1018): n is a, c, g, or t
  misc_feature (1021)..(1021): n is a, c, g, or t
  misc_feature (1030)..(1031): n is a, c, g, or t
  misc_feature (1040)..(1040): n is a, c, g, or t
  misc_feature (1042)..(1042): n is a, c, g, or t
  misc_feature (1053)..(1053): n is a, c, g, or t
  misc_feature (1065)..(1065): n is a, c, g, or t
  misc_feature (1095)..(1095): n is a, c, g, or t
  misc_feature (1124)..(1124): n is a, c, g, or t
  misc_feature (1130)..(1130): n is a, c, g, or t
  misc_feature (1140)..(1140): n is a, c, g, or t
  misc_feature (1144)..(1144): n is a, c, g, or t
  misc_feature (1146)..(1146): n is a, c, g, or t
  misc_feature (1151)..(1151): n is a, c, g, or t
  misc_feature (1154)..(1154): n is a, c, g, or t
  misc_feature (1158)..(1159): n is a, c, g, or t
  misc_feature (1161)..(1161): n is a, c, g, or t
  misc_feature (1175)..(1175): n is a, c, g, or t
  misc_feature (1185)..(1185): n is a, c, g, or t
  misc_feature (1195)..(1195): n is a, c, g, or t
  misc_feature (1203)..(1204): n is a, c, g, or t
  misc_feature (1206)..(1206): n is a, c, g, or t
  misc_feature (1220)..(1221): n is a, c, g, or t
  misc_feature (1230)..(1230): n is a, c, g, or t
  misc_feature (1244)..(1244): n is a, c, g, or t
  misc_feature (1250)..(1250): n is a, c, g, or t
  misc_feature (1252)..(1253): n is a, c, g, or t
aatagagagattactatgagaggatcgcatcaccatcaccatcacggatcctatttaggtgacactatagaatcgtcgacccacgcgtccgcggacgcgtgggctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcccgactccttcatggtcatgacacanccccggatgaanatacncattccagttttcctgatggngaacaaataggccctgaaaatctcncctncatacngantgaaaaaannggaaggtantngccaaatcaanaaactgacttgncaagctaccttgaccctgaatttgctgaantggggcccaaattgtctccgccaaaaacnaaattnggcctttttnttcntntcccnccngaannanaatttgaaacggtnggagggggcncttttttctnaaaccccnntnttcctgggaaaacnnttgggaaantttttttatgggangaaaanann

SEQ ID NO: 469 - DNA, 933 bp, Homo sapiens
tatgagaggtcgcatcaccatcaccatcacggatcctatttaggtgacactatagaatcgtcgacccacgcgtccgctggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaa

SEQ ID NO: 470 - DNA, 656 bp, Homo sapiens
catcaccatcaccatcacggatcctatttaggtgacactatagaatcgtcgacccacgcgtccgcccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaa

SEQ ID NO: 471 - DNA, 979 bp, Homo sapiens
  misc_feature (2)..(2): n is a, c, g, or t
  misc_feature (6)..(11): n is a, c, g, or t
  misc_feature (14)..(14): n is a, c, g, or t
  misc_feature (526)..(526): n is a, c, g, or t
  misc_feature (637)..(637): n is a, c, g, or t
  misc_feature (639)..(639): n is a, c, g, or t
  misc_feature (671)..(671): n is a, c, g, or t
  misc_feature (707)..(707): n is a, c, g, or t
  misc_feature (732)..(732): n is a, c, g, or t
  misc_feature (734)..(734): n is a, c, g, or t
  misc_feature (746)..(746): n is a, c, g, or t
  misc_feature (773)..(773): n is a, c, g, or t
  misc_feature (788)..(788): n is a, c, g, or t
  misc_feature (790)..(790): n is a, c, g, or t
  misc_feature (792)..(792): n is a, c, g, or t
  misc_feature (800)..(800): n is a, c, g, or t
  misc_feature (810)..(810): n is a, c, g, or t
  misc_feature (823)..(823): n is a, c, g, or t
  misc_feature (835)..(835): n is a, c, g, or t
  misc_feature (838)..(838): n is a, c, g, or t
  misc_feature (844)..(844): n is a, c, g, or t
  misc_feature (848)..(848): n is a, c, g, or t
  misc_feature (869)..(869): n is a, c, g, or t
  misc_feature (883)..(883): n is a, c, g, or t
  misc_feature (886)..(886): n is a, c, g, or t
  misc_feature (894)..(894): n is a, c, g, or t
  misc_feature (902)..(902): n is a, c, g, or t
  misc_feature (906)..(906): n is a, c, g, or t
  misc_feature (918)..(918): n is a, c, g, or t
  misc_feature (923)..(923): n is a, c, g, or t
  misc_feature (931)..(931): n is a, c, g, or t
  misc_feature (936)..(936): n is a, c, g, or t
  misc_feature (939)..(939): n is a, c, g, or t
  misc_feature (941)..(941): n is a, c, g, or t
  misc_feature (944)..(944): n is a, c, g, or t
  misc_feature (946)..(946): n is a, c, g, or t
  misc_feature (949)..(949): n is a, c, g, or t
  misc_feature (974)..(975): n is a, c, g, or t
  misc_feature (979)..(979): n is a, c, g, or t
antccnnnnnngantagagaaattactatgagaggatcgcatcaccatcaccatcacggatcctatttaggtgacactatagaatcgtcgacccacgcgtccggcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtangagatggagagactgtggagtttgatgttgttgaaggagaaaagggtgcggaggcagcaaatgttacaggtcctggtggtgttccagttcaaggcagtaaatatgcagcanancgtaaccattatagacgctatccacgtcgtangggtccttccacgcaattaccagcaaaatttaccanaatagtgagagtggggaaaaaaacnangggattggaaantgcttccgaaggccaagcccaacaaangccgggccctaccgnangngaaggttncccaccttantaacatgcggganaccctttggggngtncaaacncaantattccaacccttctttttcngggaaaaatttatnganggttgttnaaaaaccngggntgtaggaaaaanaaggnttaaaccntttgnggnanaantnttntttttcgggggaattaaaaaccccnnattn

SEQ ID NO: 472 - DNA, 1160 bp, Homo sapiens
  misc_feature (768)..(768): n is a, c, g, or t
  misc_feature (874)..(874): n is a, c, g, or t
  misc_feature (881)..(881): n is a, c, g, or t
  misc_feature (885)..(885): n is a, c, g, or t
  misc_feature (898)..(898): n is a, c, g, or t
  misc_feature (956)..(956): n is a, c, g, or t
  misc_feature (962)..(962): n is a, c, g, or t
  misc_feature (982)..(982): n is a, c, g, or t
  misc_feature (991)..(991): n is a, c, g, or t
  misc_feature (1024)..(1024): n is a, c, g, or t
  misc_feature (1028)..(1028): n is a, c, g, or t
  misc_feature (1033)..(1033): n is a, c, g, or t
  misc_feature (1036)..(1036): n is a, c, g, or t
  misc_feature (1054)..(1054): n is a, c, g, or t
  misc_feature (1058)..(1058): n is a, c, g, or t
  misc_feature (1060)..(1060): n is a, c, g, or t
  misc_feature (1062)..(1062): n is a, c, g, or t
  misc_feature (1105)..(1105): n is a, c, g, or t
  misc_feature (1110)..(1110): n is a, c, g, or t
  misc_feature (1112)..(1112): n is a, c, g, or t
  misc_feature (1118)..(1118): n is a, c, g, or t
  misc_feature (1121)..(1122): n is a, c, g, or t
  misc_feature (1125)..(1125): n is a, c, g, or t
  misc_feature (1133)..(1133): n is a, c, g, or t
  misc_feature (1143)..(1143): n is a, c, g, or t
  misc_feature (1160)..(1160): n is a, c, g, or t
aatagagaaattactatgagaggatcgcatcaccatcaccatcacggatcctatttaggtgacactatagaatcgtcgacccacgcgtccgcccacgcgtccggcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtanggggttagcttggggacctgaactgtcctggaggccccaagccatgttccccagttcagtgttgcatgtataaataaaatttctcctcttcctgcccccctttggnaatgggntganaacctgaaccaantcaaatggtagttgaagggtgactttttcctgctggcctggccttttataattttacncactcnctctgattttatgttttgancaaatttgnaactttcattttgggggggaattttggtaatgngganggggntcntcaaattattaaatctgnaaanancnaacccaaaatgtaaaaaaaaaaaaacttgggggaaaaaaaaanagttncnccattngannaancaaacctncaaaaaaatnttttatggaaaggtttn

SEQ ID NO: 473 - DNA, 1596 bp, Homo sapiens
atgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtga

SEQ ID NO: 474 - DNA, 1289 bp, Homo sapiens
  misc_feature (889)..(889): n is a, c, g, or t
  misc_feature (942)..(942): n is a, c, g, or t
  misc_feature (944)..(944): n is a, c, g, or t
  misc_feature (957)..(957): n is a, c, g, or t
  misc_feature (969)..(969): n is a, c, g, or t
  misc_feature (980)..(980): n is a, c, g, or t
  misc_feature (988)..(988): n is a, c, g, or t
  misc_feature (992)..(992): n is a, c, g, or t
  misc_feature (1025)..(1025): n is a, c, g, or t
  misc_feature (1033)..(1033): n is a, c, g, or t
  misc_feature (1055)..(1055): n is a, c, g, or t
  misc_feature (1066)..(1066): n is a, c, g, or t
  misc_feature (1101)..(1101): n is a, c, g, or t
  misc_feature (1108)..(1108): n is a, c, g, or t
  misc_feature (1120)..(1120): n is a, c, g, or t
  misc_feature (1122)..(1122): n is a, c, g, or t
  misc_feature (1125)..(1125): n is a, c, g, or t
  misc_feature (1128)..(1128): n is a, c, g, or t
  misc_feature (1134)..(1134): n is a, c, g, or t
  misc_feature (1146)..(1146): n is a, c, g, or t
  misc_feature (1151)..(1151): n is a, c, g, or t
  misc_feature (1159)..(1159): n is a, c, g, or t
  misc_feature (1166)..(1166): n is a, c, g, or t
  misc_feature (1172)..(1172): n is a, c, g, or t
  misc_feature (1177)..(1177): n is a, c, g, or t
  misc_feature (1179)..(1179): n is a, c, g, or t
  misc_feature (1184)..(1184): n is a, c, g, or t
  misc_feature (1191)..(1191): n is a, c, g, or t
  misc_feature (1195)..(1195): n is a, c, g, or t
  misc_feature (1199)..(1200): n is a, c, g, or t
  misc_feature (1211)..(1211): n is a, c, g, or t
  misc_feature (1214)..(1214): n is a, c, g, or t
  misc_feature (1217)..(1217): n is a, c, g, or t
  misc_feature (1237)..(1237): n is a, c, g, or t
  misc_feature (1247)..(1247): n is a, c, g, or t
  misc_feature (1257)..(1257): n is a, c, g, or t
  misc_feature (1261)..(1261): n is a, c, g, or t
  misc_feature (1269)..(1269): n is a, c, g, or t
  misc_feature (1277)..(1277): n is a, c, g, or t
  misc_feature (1281)..(1281): n is a, c, g, or t
  misc_feature (1286)..(1286): n is a, c, g, or t
tagagaaattactatgagaggatcgcatcaccatcaccatcacggatcctatttaggtgacactatagaatcgtcgacccacgcgtccgcccacgcgtccgatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcntttgacaccttagttccttactgtttacagtttaggagtactgatagggggtncntgcttaataaacntgtcccaatacngtaagtaaagnggttttgnttgnttcctttgaaatggagtcttgctctgtcccccnggctggangcgggggcgcaatcccggctcnctgcatccccnggccccccggggtccaagcaattcccccgcccccncctcccnagtagctgggantnacnggncccggncccccccccccncctantttttgtntttttanaaaaanggggntnccccnaattggncccncccnntgggcctgaanccntgnccctgggacccccccccccntggccccccnaagggggggnaaanggggggancccccccncccnccccnaaa

SEQ ID NO: 475 - DNA, 913 bp, Homo sapiens
catcaccatcaccatcacggatcctatttaggtgacactatagaatcgtcgacccacgcgtccgcccacgcgtccgcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagagatgaatcagatgatgataatatgtaacatttactccagcatctattgtattttaaatttctactccagtccaatgtaactatttagccctggattatacatac

SEQ ID NO: 476 - DNA, 1013 bp, Homo sapiens
  misc_feature (1)..(1): n is a, c, g, or t
  misc_feature (763)..(763): n is a, c, g, or t
  misc_feature (786)..(786): n is a, c, g, or t
  misc_feature (802)..(802): n is a, c, g, or t
  misc_feature (860)..(860): n is a, c, g, or t
  misc_feature (875)..(875): n is a, c, g, or t
  misc_feature (893)..(893): n is a, c, g, or t
  misc_feature (905)..(905): n is a, c, g, or t
  misc_feature (931)..(931): n is a, c, g, or t
  misc_feature (944)..(945): n is a, c, g, or t
  misc_feature (948)..(948): n is a, c, g, or t
  misc_feature (983)..(983): n is a, c, g, or t
  misc_feature (990)..(990): n is a, c, g, or t
  misc_feature (992)..(992): n is a, c, g, or t
  misc_feature (1006)..(1006): n is a, c, g, or t
nttagagaaattactatgagaggatcgcatcaccatcaccatcacggatcctatttaggtgacactatagaatcgtcgacccacgcgtccgcccacgcgtccggcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaaatcgatatcagcaatgtaaaaatcccaaaacatcttactgatgcttacttcagnaagaagaagctgcggaagcccanacaccaggaaggtganatcttcgacacagaaaaagagaaatatgagattacggaaccagcgcaagattgatcanaaagctgtggactcncaaatttttaccaaaatncaaagctattcntcagcctccagggctacctgcgattnggttttgctctgnnaanggaatttttcctcccaaatttggtgtttctaaatntcttaanancctatttaaatacntgactac

SEQ ID NO: 477 - DNA, 814 bp, Homo sapiens
  misc_feature (7)..(7): n is a, c, g, or t
  misc_feature (655)..(655): n is a, c, g, or t
  misc_feature (745)..(745): n is a, c, g, or t
  misc_feature (756)..(756): n is a, c, g, or t
  misc_feature (784)..(784): n is a, c, g, or t
  misc_feature (791)..(791): n is a, c, g, or t
  misc_feature (794)..(794): n is a, c, g, or t
  misc_feature (796)..(796): n is a, c, g, or t
  misc_feature (811)..(811): n is a, c, g, or t
  misc_feature (814)..(814): n is a, c, g, or t
tcttaangaggagaattaactatgagaggatcgcatcaccatcaccatcacggatcctatttaggtgacactatagaatcgtcgacccacgcgtccgccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatcntgcatgggaggatttgattcatgagatctatactgttggaaaacgcttcaaagaggcaaataacttcctgtggcccttcaaattgtcttnctccccgaggnggaatgaagaaaaagacacccctttttngtaaaanggngnagatgctggccaaanggn

SEQ ID NO: 478 - DNA, 945 bp, Homo sapiens
tatgagaggatcgcatcaccatcaccatcacggatcctatttaggtgacactatagaatcgtcgacccacgcgtccgcgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcc

SEQ ID NO: 479 - DNA, 875 bp, Homo sapiens
tatgagaggatcgcatcaccatcaccatcacggatcctatttaggtgacactatagaatcgtcgacccacgcgtccggaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgag

SEQ ID NO: 480 - DNA, 1077 bp, Homo sapiens
  misc_feature (1)..(1): n is a, c, g, or t
  misc_feature (749)..(749): n is a, c, g, or t
  misc_feature (830)..(830): n is a, c, g, or t
  misc_feature (855)..(855): n is a, c, g, or t
  misc_feature (857)..(857): n is a, c, g, or t
  misc_feature (889)..(889): n is a, c, g, or t
  misc_feature (919)..(919): n is a, c, g, or t
  misc_feature (922)..(922): n is a, c, g, or t
  misc_feature (943)..(943): n is a, c, g, or t
  misc_feature (945)..(945): n is a, c, g, or t
  misc_feature (967)..(967): n is a, c, g, or t
  misc_feature (972)..(972): n is a, c, g, or t
  misc_feature (983)..(983): n is a, c, g, or t
  misc_feature (1000)..(1000): n is a, c, g, or t
  misc_feature (1003)..(1003): n is a, c, g, or t
  misc_feature (1011)..(1012): n is a, c, g, or t
  misc_feature (1026)..(1027): n is a, c, g, or t
  misc_feature (1054)..(1077): n is a, c, g, or t
naatagagaaattaactatgagaggatcgcatcaccatcaccatcacggatcctatttaggtgacactatagaatcgtcgacccacgcgtccgcggacgcgtgggcaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaanaagctgctcatgatggctggtatcgatgactgctacacctcagcccggggctgcactgccaccctgggcaacttcgccaangccacctttgatgccattttctaananctacagctacctgaacccccgacctctggaangaaactgtattcaccaagtctccctatcanganttcactgaccacctcgtcaananccacaccaaaatctccgtgcancggantcaggctccanctgtggctacaaaatanggntttttttnncaaaaaaaataaanntgaattaaccgtgaaaaaaaaaaaaannnnnnnnnnnnnnnnnnnnnnnn

SEQ ID NO: 481 - DNA, 846 bp, Homo sapiens
  misc_feature (708)..(708): n is a, c, g, or t
  misc_feature (738)..(738): n is a, c, g, or t
  misc_feature (781)..(781): n is a, c, g, or t
  misc_feature (785)..(785): n is a, c, g, or t
  misc_feature (788)..(788): n is a, c, g, or t
  misc_feature (812)..(812): n is a, c, g, or t
  misc_feature (816)..(816): n is a, c, g, or t
  misc_feature (822)..(822): n is a, c, g, or t
  misc_feature (836)..(836): n is a, c, g, or t
taagaggagaattaactatgagaggatcgcatcaccatcaccatcacggatcctatttaggtgacactatagaatcgtcgacccacgcgtccgctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaaaaaagtggtcaataaattgattccagacagcattggaaaagacatagaaaagggnttgccaatctatttatcctctccatgatgncttcgttagaaaagtaaaaatgctgaagaaaccccaagtttgnaatnggnaaagctcatggagcttcatggggnaagncagtanttctggaaaagccnctggggacga

SEQ ID NO: 482 - DNA, 844 bp, Homo sapiens
ctatgagaggacgcatcaccatcaccatcacggatcctatttaggtgacactatagaatcgtcgactctggaccttggctgtcactcagttaaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaagagaactcatgttattttttaaccccgtcaacagatctaggaaaatattttgatcttcaacaaattgccctttactctccccgtatgagttagaataataaatatttagtaggtgagttttcacctcgaattctgttttcttgatttttacgtttgaagacatagcagcagatgccattacaattattgaccccccgaccttgtataaaacccctaccctcacataccttagtcagtgaacttaattgagccgtgcctttcccagttgccccgatctttcgggccgaattgcttat

SEQ ID NO: 483 - DNA, 435 bp, Homo sapiens
atggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatag

SEQ ID NO: 484 - DNA, 795 bp, Homo sapiens
atggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacatttttattaccactaatatgatgtcatcacaaaatactgccaatgaatcatcaaatgcattgaaaagaaaacgtgaagatgatgatgatgacgatgatgatgatgatgactatgataatctgtaa

SEQ ID NO: 485 - DNA, 429 bp, Homo sapiens
atggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttga

SEQ ID NO: 486 - DNA, 1221 bp, Homo sapiens
  misc_feature (12)..(12): n is a, c, g, or t
  misc_feature (911)..(911): n is a, c, g, or t
  misc_feature (958)..(958): n is a, c, g, or t
  misc_feature (981)..(981): n is a, c, g, or t
  misc_feature (983)..(983): n is a, c, g, or t
  misc_feature (1004)..(1004): n is a, c, g, or t
  misc_feature (1011)..(1011): n is a, c, g, or t
  misc_feature (1044)..(1044): n is a, c, g, or t
  misc_feature (1055)..(1055): n is a, c, g, or t
  misc_feature (1057)..(1057): n is a, c, g, or t
  misc_feature (1063)..(1063): n is a, c, g, or t
  misc_feature (1074)..(1075): n is a, c, g, or t
  misc_feature (1082)..(1082): n is a, c, g, or t
  misc_feature (1091)..(1091): n is a, c, g, or t
  misc_feature (1095)..(1095): n is a, c, g, or t
  misc_feature (1098)..(1098): n is a, c, g, or t
  misc_feature (1108)..(1108): n is a, c, g, or t
  misc_feature (1116)..(1116): n is a, c, g, or t
  misc_feature (1129)..(1129): n is a, c, g, or t
  misc_feature (1138)..(1138): n is a, c, g, or t
  misc_feature (1143)..(1143): n is a, c, g, or t
  misc_feature (1147)..(1147): n is a, c, g, or t
  misc_feature (1149)..(1149): n is a, c, g, or t
  misc_feature (1152)..(1152): n is a, c, g, or t
  misc_feature (1159)..(1159): n is a, c, g, or t
  misc_feature (1172)..(1172): n is a, c, g, or t
  misc_feature (1179)..(1179): n is a, c, g, or t
  misc_feature (1181)..(1181): n is a, c, g, or t
  misc_feature (1187)..(1187): n is a, c, g, or t
  misc_feature (1190)..(1190): n is a, c, g, or t
  misc_feature (1194)..(1194): n is a, c, g, or t
  misc_feature (1196)..(1196): n is a, c, g, or t
  misc_feature (1200)..(1200): n is a, c, g, or t
  misc_feature (1202)..(1202): n is a, c, g, or t
  misc_feature (1205)..(1205): n is a, c, g, or t
  misc_feature (1217)..(1217): n is a, c, g, or t
  misc_feature (1220)..(1220): n is a, c, g, or t
tagagaaattanctatgagaggatcgcatcaccatcaccatcacggatcctatttaggtgacactcctagaatcgtcgacccacgcgtccgcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagcccnttgaaaattactttaaagaatttaagaagccctatagaatggttacnggaaaaccttcttaagtatctgngnaaaagtattatatgcatactnaacctcngaggggaaagcaaagacaaaactttttttgggntgatatgttananacaaangttttgaaaanngaaaacnttaattganttanggnggtttggctnaagcaagncaaaccccttttntgcaatttnaaaangggncnggnaaaaaangggggccttcccngcccctnanccttgngcntttnantggncnggnaattaattcccncang

SEQ ID NO: 487 - DNA, 708 bp, Homo sapiens
atgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctag

SEQ ID NO: 488 - DNA, 1725 bp, Homo sapiens
atggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtga

SEQ ID NO: 489 - DNA, 979 bp, Homo sapiens
tatgagaggtcgcatcaccatcaccatcacggatcctatttaggtgacactatagaatcgtcgacccacgcgtccgtgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaaccccgctccctga

SEQ ID NO: 490 - DNA, 1217 bp, Homo sapiens
  misc_feature (934)..(934): n is a, c, g, or t
  misc_feature (939)..(939): n is a, c, g, or t
  misc_feature (971)..(971): n is a, c, g, or t
  misc_feature (986)..(986): n is a, c, g, or t
  misc_feature (1011)..(1011): n is a, c, g, or t
  misc_feature (1016)..(1016): n is a, c, g, or t
  misc_feature (1031)..(1031): n is a, c, g, or t
  misc_feature (1038)..(1038): n is a, c, g, or t
  misc_feature (1040)..(1040): n is a, c, g, or t
  misc_feature (1049)..(1049): n is a, c, g, or t
  misc_feature (1059)..(1059): n is a, c, g, or t
  misc_feature (1063)..(1063): n is a, c, g, or t
  misc_feature (1071)..(1071): n is a, c, g, or t
  misc_feature (1073)..(1073): n is a, c, g, or t
  misc_feature (1084)..(1084): n is a, c, g, or t
  misc_feature (1102)..(1102): n is a, c, g, or t
  misc_feature (1104)..(1104): n is a, c, g, or t
  misc_feature (1109)..(1109): n is a, c, g, or t
  misc_feature (1113)..(1113): n is a, c, g, or t
  misc_feature (1121)..(1121): n is a, c, g, or t
  misc_feature (1141)..(1142): n is a, c, g, or t
  misc_feature (1150)..(1150): n is a, c, g, or t
  misc_feature (1163)..(1163): n is a, c, g, or t
  misc_feature (1168)..(1170): n is a, c, g, or t
  misc_feature (1174)..(1174): n is a, c, g, or t
  misc_feature (1177)..(1177): n is a, c, g, or t
  misc_feature (1196)..(1196): n is a, c, g, or t
  misc_feature (1201)..(1201): n is a, c, g, or t
  misc_feature (1206)..(1207): n is a, c, g, or t
  misc_feature (1210)..(1210): n is a, c, g, or t
  misc_feature (1214)..(1215): n is a, c, g, or t
tagagaaattactatgagaggatcgcatcaccatcaccatcacggatcctatttaggtgacactatagaatcgtcgacccacgcgtccgagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaaccgacttccagattaccaggaacaggacatcttcctctgganaaaanagactggatttggatttaggattctgggtggnaaatgaaccaggggnaacctattttatattggtcacatcntaccnctgggtgctgctganactgacngnccccctgangtctggaaangaantaatctgngnggatgggaacnccagtaattggaaaatcncnccacnttgnggtccacnttatgcaaaaagctgccaannaaggcccngtcaatccccggngcggnnnaaanggnttttggggggcccaaaccnaaaanaaggnnccncccnncc

SEQ ID NO: 491 - DNA, 814 bp, Homo sapiens
  misc_feature (4)..(4): n is a, c, g, or t
  misc_feature (130)..(130): n is a, c, g, or t
  misc_feature (224)..(224): n is a, c, g, or t
  misc_feature (450)..(450): n is a, c, g, or t
  misc_feature (454)..(454): n is a, c, g, or t
  misc_feature (795)..(795): n is a, c, g, or t
  misc_feature (801)..(801): n is a, c, g, or t
taanaggagaattaactatgagaggatcgcatcaccatcaccatcacggatcctatttaggtgacactatagaatcgtcgacccacgcgtccgggacccgggacgacgagtacgactacctattcaaagnggtgctcatcggggactcaggcgtgggcaagagcaacctgctgtcgcgcttcacccgcaacgagttcaacctggagagcaagagcaccatcggngtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgntggngggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgggggcacgtcctccgcccgtccccgncacggnatcctctggcccc

SEQ ID NO: 492 - DNA, 930 bp, Homo sapiens
atggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggacggactccatgttaaagtacatgcagaggaagatcgatgagttctga

SEQ ID NO: 493 - DNA, 1205 bp, Homo sapiens
  misc_feature (887)..(887): n is a, c, g, or t
  misc_feature (904)..(904): n is a, c, g, or t
  misc_feature (943)..(943): n is a, c, g, or t
  misc_feature (965)..(965): n is a, c, g, or t
  misc_feature (974)..(974): n is a, c, g, or t
  misc_feature (989)..(989): n is a, c, g, or t
  misc_feature (994)..(994): n is a, c, g, or t
  misc_feature (1004)..(1004): n is a, c, g, or t
  misc_feature (1026)..(1026): n is a, c, g, or t
  misc_feature (1033)..(1033): n is a, c, g, or t
  misc_feature (1042)..(1042): n is a, c, g, or t
  misc_feature (1053)..(1053): n is a, c, g, or t
  misc_feature (1055)..(1057): n is a, c, g, or t
  misc_feature (1059)..(1059): n is a, c, g, or t
  misc_feature (1064)..(1064): n is a, c, g, or t
  misc_feature (1077)..(1077): n is a, c, g, or t
  misc_feature (1086)..(1086): n is a, c, g, or t
  misc_feature (1090)..(1090): n is a, c, g, or t
  misc_feature (1094)..(1095): n is a, c, g, or t
  misc_feature (1121)..(1121): n is a, c, g, or t
  misc_feature (1126)..(1126): n is a, c, g, or t
  misc_feature (1134)..(1134): n is a, c, g, or t
  misc_feature (1138)..(1138): n is a, c, g, or t
  misc_feature (1148)..(1148): n is a, c, g, or t
  misc_feature (1157)..(1157): n is a, c, g, or t
  misc_feature (1162)..(1162): n is a, c, g, or t
  misc_feature (1165)..(1165): n is a, c, g, or t
  misc_feature (1168)..(1168): n is a, c, g, or t
  misc_feature (1181)..(1181): n is a, c, g, or t
  misc_feature (1187)..(1187): n is a, c, g, or t
agagagattactatgagaggatcgcatcaccatcaccatcacggatcctatttaggtgacactatagaatcgtcgacccacgcgtccggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcnaataaccgagcttatcngtttgcaggtcgaagtagaaggaacccaatatctcttangctgtcgaaacatgttggaaanttgcaatcncccgtctaaggttcnaaacncttgacttanattcccactgcccattgacttntggccgnacttttacnaagcccggctntnnntncacgnatttccgttaaangcgtgtaanatgntttnnaaccaaaagcctttcgctaggggaangggancctggaanattnaacttggtgnccccccccntcccnacngtntataacccggggnacctgnaaacccgggttttactcc

SEQ ID NO: 494 - DNA, 2745 bp, Homo sapiens
atggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctg

SEQ ID NO: 495 - DNA, 853 bp, Homo sapiens
  misc_feature (1)..(2): n is a, c, g, or t
  misc_feature (13)..(13): n is a, c, g, or t
nncccatattccnccctagagatactagagaggatgcatcaccatcaccatcacggtcgacccacgcgtccgcttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaag

SEQ ID NO: 496 - DNA, 976 bp, Homo sapiens
tgagaggtcgcatcaccatcaccatcacggatcctatttaggtgacactatagaatcgtcgacccacgcgtccgcccacgcgtccggggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcg

SEQ ID NO: 497 - DNA, 1122 bp, Homo sapiens
  misc_feature (717)..(717): n is a, c, g, or t
  misc_feature (738)..(738): n is a, c, g, or t
  misc_feature (786)..(786): n is a, c, g, or t
  misc_feature (833)..(833): n is a, c, g, or t
  misc_feature (835)..(835): n is a, c, g, or t
  misc_feature (859)..(859): n is a, c, g, or t
  misc_feature (861)..(861): n is a, c, g, or t
  misc_feature (868)..(868): n is a, c, g, or t
  misc_feature (875)..(875): n is a, c, g, or t
  misc_feature (881)..(881): n is a, c, g, or t
  misc_feature (908)..(908): n is a, c, g, or t
  misc_feature (949)..(949): n is a, c, g, or t
  misc_feature (958)..(958): n is a, c, g, or t
  misc_feature (960)..(960): n is a, c, g, or t
  misc_feature (971)..(971): n is a, c, g, or t
  misc_feature (985)..(987): n is a, c, g, or t
  misc_feature (991)..(991): n is a, c, g, or t
  misc_feature (997)..(997): n is a, c, g, or t
  misc_feature (1003)..(1003): n is a, c, g, or t
  misc_feature (1005)..(1005): n is a, c, g, or t
  misc_feature (1009)..(1010): n is a, c, g, or t
  misc_feature (1013)..(1013): n is a, c, g, or t
  misc_feature (1016)..(1016): n is a, c, g, or t
  misc_feature (1027)..(1027): n is a, c, g, or t
  misc_feature (1029)..(1029): n is a, c, g, or t
  misc_feature (1041)..(1041): n is a, c, g, or t
  misc_feature (1058)..(1058): n is a, c, g, or t
  misc_feature (1079)..(1079): n is a, c, g, or t
  misc_feature (1082)..(1082): n is a, c, g, or t
  misc_feature (1085)..(1085): n is a, c, g, or t
  misc_feature (1099)..(1101): n is a, c, g, or t
  misc_feature (1106)..(1106): n is a, c, g, or t
  misc_feature (1113)..(1113): n is a, c, g, or t
  misc_feature (1118)..(1118): n is a, c, g, or t
  misc_feature (1121)..(1121): n is a, c, g, or t
agagaaattactatgagaggatcgcatcaccatcaccatcacggatcctatttaggtgacactatagaatcgtcgacccacgcgtccgccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtganagggagctggaaaagtgccancgaaaccacgagggtgatgaggacgacagccacgtccgggcccagcangcctgcattgaggccaagcacgacaagtacatggcggaacatggacnancttttttctcaggtggatgaaaanangaaaaancgagacntccccnactacctgtgtggcaaaatcaactttnaactgatgcgggaacccgtgcatcacgcccaattggcattnccttacaancncaaggacatcnaggaacaacctgcnnngtgngggttnattttnancccnnganccngaaaccccctnanccaagaaaaaantttatccccaatttggntattaaagaagtttatttganccnttnttttctaaaatggnnnggggngaaaaanaattnaant

SEQ ID NO: 498 - DNA, 789 bp, Homo sapiens
  misc_feature (756)..(756): n is a, c, g, or t
taagaggagaattaactatgagaggatcgcatcaccatcaccatcacggatcctatttaggtgacactatagaatcgtcgacccacgcgtccgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggctacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactgggnggctttgatgggcaagcccgtcagcccacacca

SEQ ID NO: 499 - DNA, 1284 bp, Homo sapiens
  misc_feature (936)..(936): n is a, c, g, or t
  misc_feature (938)..(938): n is a, c, g, or t
  misc_feature (952)..(952): n is a, c, g, or t
  misc_feature (989)..(989): n is a, c, g, or t
  misc_feature (1005)..(1005): n is a, c, g, or t
  misc_feature (1030)..(1030): n is a, c, g, or t
  misc_feature (1046)..(1046): n is a, c, g, or t
  misc_feature (1048)..(1048): n is a, c, g, or t
  misc_feature (1053)..(1053): n is a, c, g, or t
  misc_feature (1055)..(1055): n is a, c, g, or t
  misc_feature (1070)..(1070): n is a, c, g, or t
  misc_feature (1083)..(1083): n is a, c, g, or t
  misc_feature (1091)..(1091): n is a, c, g, or t
  misc_feature (1128)..(1129): n is a, c, g, or t
  misc_feature (1151)..(1151): n is a, c, g, or t
  misc_feature (1157)..(1159): n is a, c, g, or t
  misc_feature (1165)..(1165): n is a, c, g, or t
  misc_feature (1169)..(1170): n is a, c, g, or t
  misc_feature (1172)..(1172): n is a, c, g, or t
  misc_feature (1180)..(1181): n is a, c, g, or t
  misc_feature (1200)..(1200): n is a, c, g, or t
  misc_feature (1211)..(1212): n is a, c, g, or t
  misc_feature (1217)..(1217): n is a, c, g, or t
  misc_feature (1225)..(1225): n is a, c, g, or t
  misc_feature (1227)..(1227): n is a, c, g, or t
  misc_feature (1241)..(1241): n is a, c, g, or t
  misc_feature (1257)..(1257): n is a, c, g, or t
  misc_feature (1269)..(1269): n is a, c, g, or t
  misc_feature (1279)..(1280): n is a, c, g, or t
tagagaaattactatgagaggatcgcatcaccatcaccatcacggatcctatttaggtgacactatagaatcgtcgacccacgcgtccggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaaagcttctgtgatgctctttatgaaaggaaacaaacaggaagcaaaatgtggattcagcaaacaaattctggaaatactaatagtactggggttgaatatgaaacatncnatatattggaggangaaaaaattcggcaaggattaaagcttactcaaaatnggccaacatacccccnacctgtatgtgaaaggggaactggnggaggattggaaattngngaagnanctgaaaaaaaatggngaattgctgcctntactgganagaaaaaaataaaaaatcttaaacttggggcccactnntggaaaaaaattttattacttngggacnnnttctgnattnntnccccaaannggactaagaaaaaaaaatncccgccttccnnaaaangtttgggnanttccaaggccggcnaaaaaaaggaggtaanttttttcccccnaaaaaaaggnnaaaa

SEQ ID NO: 500 - DNA, 2158 bp, Homo sapiens
atggcaaaatctccggaaaatagcaccctggaagaaattctgggtcagtatcagcgtagcctgcgtgaacatgcaagccgtagcattcatcagctgacctgtgcactgaaagaaggtgacgttaccattggtgaagatgcaccgaatctgagctttagcaccagcgttggtaatgaagatgcacgtaccgcatggcctgaactgcagcagagccacgcagttaatcagctgaaagatctgctgcgtcagcaggcagataaagaaagcgaagttagcccgagccgtcgtcgtaaaatgtctccgctgcgtagcctggaacatgaagaaaccaatatgccgaccatgcatgatctggtgcataccattaatgatcagagccagtatattcatcatctggaagccgaagtgaaattttgcaaagaagaactgagcggcatgaaaaataaaattcaggtggtggtgctggaaaatgaaggtctgcagcagcagctgaaaagccagcgtcaggaagaaaccctgcgcgaacagaccctgctggatgcaagcggtaatatgcataatagctggattaccacaggcgaagatagcggtgttggtgaaaccagcaaacgtccgtttagccatgataatgccgattttggtaaagcagcatctgccggtgaacagctggaactggaaaaactgaaactgacctacgaagaaaaatgcgaaattgaagaaagccagctgaaatttctgcgtaatgatctggcagaatatcagcgtacctgtgaagatctgaaagagcagctgaaacacaaagaatttctgctggcagcaaatacctgtaatcgtgttggtggtctgtgtctgaaatgtgcacagcatgaagcagttctgagccagacccataccaatgttcatatgcagaccattgaacgtctggttaaagaacgtgatgatctgatgagcgcactggttagcgttcgtagcagcctggcagatacccagcagcgtgaagcaagcgcatatgaacaggttaaacaggttctgcagattagcgaagaagccaactttgaaaaaaccaaagccctgattcagtgtgatcagctgcgtaaagaactggaacgtcaggcagaacgtctggaaaaagaactggcaagccagcaggaaaaacgcgcaatcgagaaagacatgatgaaaaaagagatcaccaaagaacgcgaatatatgggcagcaaaatgctgattctgtctcagaatattgcacagctggaagcacaggttgaaaaagtgaccaaagagaaaattagcgccattaaccagctggaagaaatccagagccaactggctagccgtgaaatggatgttaccaaagtttgcggtgaaatgcgctatcagctgaacaaaaccaacatggaaaaagatgaagccgaaaaagaacatcgtgaatttcgtgccaaaaccaatcgcgatctggaaatcaaagaccaggaaatcgaaaaactgcgcattgaactggatgaaagcaaacagcatctggaacaggaacagcagaaagcagcactggcacgtgaagaatgtctgcgtctgaccgaactgctgggtgaaagcgaacatcagctgcatctgacccgtcaggaaaaagatagcattcagcagagctttagcaaagaagcaaaagcacaggcactgcaggcacagcagcgcgaacaggaactgacccagaaaattcagcagatggaagcccagcatgataaaaccgaaaacgaacagtatctgctgctgaccagccagaatacctttctgaccaaactgaaagaagaatgttgcaccctggcaaaaaaactggaacaaatcagccagaaaacccgtagcgaaattgcccagctgagccaggaaaaacgttatacctacgacaaactgggtaaactgcagcgtcgtaatgaagaactggaagaacagtgtgttcagcatggtcgtgttcatgaaaccatgaaacagcgtctgcgtcagctggataaacatagccaggcaaccgcacagcagctggttcagctgctgagcaaacagaatcaactgctgctggaacgccagagcctgagcgaagaagttgatcgtctgcgtacccagctgccgagcatgccgcagagcgattgctaagcggccgcttaattaa

SEQ ID NO: 501 - DNA, 1425 bp, Homo sapiens
  misc_feature (1)..(1): n is a, c, g, or t
  misc_feature (10)..(13): n is a, c, g, or t
  misc_feature (1151)..(1151): n is a, c, g, or t
  misc_feature (1164)..(1164): n is a, c, g, or t
  misc_feature (1166)..(1167): n is a, c, g, or t
  misc_feature (1173)..(1173): n is a, c, g, or t
  misc_feature (1191)..(1191): n is a, c, g, or t
  misc_feature (1229)..(1229): n is a, c, g, or t
  misc_feature (1236)..(1236): n is a, c, g, or t
  misc_feature (1273)..(1274): n is a, c, g, or t
  misc_feature (1291)..(1292): n is a, c, g, or t
  misc_feature (1295)..(1295): n is a, c, g, or t
  misc_feature (1304)..(1304): n is a, c, g, or t
  misc_feature (1342)..(1342): n is a, c, g, or t
  misc_feature (1348)..(1348): n is a, c, g, or t
  misc_feature (1357)..(1357): n is a, c, g, or t
  misc_feature (1371)..(1371): n is a, c, g, or t
  misc_feature (1378)..(1378): n is a, c, g, or t
  misc_feature (1387)..(1387): n is a, c, g, or t
  misc_feature (1405)..(1405): n is a, c, g, or t
  misc_feature (1419)..(1419): n is a, c, g, or t
nggcgaaggnnnnggatatactgacttacctataaataggcgtatcacgaggccctttcgtcttccctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtaaatgtatcttcaaacagtctttcttttgtatcaccttcactgcaaatggaagactccaattcaaacaaggagaacatggcaaccttgtttacaatttggggtactctgtgtgaccgcgcctatccctcggactgtcccgaacatggaccaatgacctttggtcctgaccctcccataaaaaacaaaaacagggctttccctcccaaacagccttgttccccctccagtcaattggggggagcaaaaattgggggtttgaactggaaaaaccatttcttgggcggaattgctttggacctccaattggcccacaaaagtccctcctgggaaaaaacccaaatggaacaaaaagggaccttaccatatcctagaaaaaataccaacagggggccctcaaattccggctccttccccctaataaaaaagaatcgaattgcctaatcttattatctcacccccccaaaccaattaaaaatcaaatctcttgctaccctccccactgnaaacatatttttncnnactacnaaaacaacccccctctanaatacacgttttatttcaaaacaccaaaaaaaacctcnaaaatcntaatataaaaaaaaaattataaataacactcataatnntatctagaaccttaccnnacnctaaagcanatatcaactaaaaaaaaaccactcctccttctatccanctcccncaaaattanaaacccataataancccaacncttgcaaantatatctcaaacatcctntcaataataaaganatataa

SEQ ID NO: 502 - DNA, 1052 bp, Homo sapiens
  misc_feature (835)..(835): n is a, c, g, or t
  misc_feature (845)..(846): n is a, c, g, or t
  misc_feature (851)..(851): n is a, c, g, or t
  misc_feature (863)..(863): n is a, c, g, or t
  misc_feature (873)..(873): n is a, c, g, or t
  misc_feature (884)..(884): n is a, c, g, or t
  misc_feature (891)..(891): n is a, c, g, or t
  misc_feature (905)..(905): n is a, c, g, or t
  misc_feature (909)..(910): n is a, c, g, or t
  misc_feature (928)..(928): n is a, c, g, or t
  misc_feature (931)..(931): n is a, c, g, or t
  misc_feature (936)..(936): n is a, c, g, or t
  misc_feature (938)..(938): n is a, c, g, or t
  misc_feature (946)..(947): n is a, c, g, or t
  misc_feature (952)..(952): n is a, c, g, or t
  misc_feature (957)..(957): n is a, c, g, or t
  misc_feature (962)..(962): n is a, c, g, or t
  misc_feature (964)..(964): n is a, c, g, or t
  misc_feature (973)..(973): n is a, c, g, or t
  misc_feature (980)..(980): n is a, c, g, or t
  misc_feature (992)..(993): n is a, c, g, or t
  misc_feature (998)..(998): n is a, c, g, or t
  misc_feature (1007)..(1007): n is a, c, g, or t
  misc_feature (1009)..(1009): n is a, c, g, or t
  misc_feature (1016)..(1017): n is a, c, g, or t
  misc_feature (1024)..(1024): n is a, c, g, or t
  misc_feature (1034)..(1035): n is a, c, g, or t
  misc_feature (1038)..(1038): n is a, c, g, or t
  misc_feature (1041)..(1041): n is a, c, g, or t
  misc_feature (1044)..(1044): n is a, c, g, or t
  misc_feature (1049)..(1049): n is a, c, g, or t
aatagagaaattactatgagaggatcgcatcaccatcaccatcacggatcctatttaggtgacactatagaatcgtcgacccacgcgtccgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcanaagccaaacnngaaancgaaaatatganaaagaaaaanggaggaaaaanaacgtcnagctcccatggaanctcnncctcaaagaacaacgtgnaangggancntaaaatgnnaaaanctaanaaaanantgaaaaaancggaaanttgatgaccttnntttcnctttacccncnggaaaanngtttganaaaacctttnnaanttnaancgaanccc

SEQ ID NO: 503 - DNA, 1331 bp, Homo sapiens
  misc_feature (9)..(9): n is a, c, g, or t
  misc_feature (777)..(777): n is a, c, g, or t
  misc_feature (885)..(885): n is a, c, g, or t
  misc_feature (1276)..(1276): n is a, c, g, or t
  misc_feature (1324)..(1324): n is a, c, g, or t
gtccgagcnccaaagagatactagagaggatgcatcaccatcaccatcacggtcgacccacgcgtccgttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtanggagtgggggctgctagagggggattagttccggagactgagactgttggctccacctccaagctgagctagggtggagggcagggtgggcaggaagtgacaggaaantaagctggtcctctccctggctgctgctctggatggccagagaacaagatgctcccttgctgagctcctggaaacgtggaaggagaagctaggccctggcacagtggtaagtggactgggccacataggggggaatgagccatggaaaaaagcaaaggaaaccttgcttctggctcaccattgctgttttggaccttgttgaattccttggctttactctgcctacaactcgggaaaaatcccgccggcacgacaatcaaacctcgggaacccccttcccaaagcggctcgcccacccccgggtgttccctgcggcccccggcccttaccaaacccctcttcaacaagcgccccttcctccggacccccccaaattacccgcccccccaanccccccaaggggctcccttgcgcccccaacccctctcggcgtcacacngtctccc

SEQ ID NO: 504 - DNA, 579 bp, Homo sapiens
catcaccatcaccatcacggatcctatttaggtgacactatagaatcgtcgacccacgcgtccgggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggatatggtggaagcaccccttgtcctgtgcttgtgggagactttgcggggaggaggcagcagacactggagatgacattcttccacacgagacggggcttcagccgggcatggtccctctcaagtatctcctgtaggaaggggt

SEQ ID NO: 505 - DNA, 613 bp, Homo sapiens
  misc_feature (9)..(9): n is a, c, g, or t
  misc_feature (42)..(42): n is a, c, g, or t
  misc_feature (74)..(74): n is a, c, g, or t
tcgagaatntaaaaaattatttgctttgtgagcggatacatntaatagattaattgtgagcggataacaatttncacagaattcattaaagaggagaaattaactatgagaggatcgcatcaccatcaccatcacggatcctatttaggtgacactatagaatcgtcgacccacgcgtccggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctc

SEQ ID NO: 506 - DNA, 863 bp, Homo sapiens
tgagaggatcgcatcaccatcaccatcacggatcctatttaggtgacactatagaatcgtcgacccacgcgtccggcgccatggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtagtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggacggcatgccagtgaaatgagggatttgccaagtcgatatgttgaaatagtgtctcagtttgaaactgaattctacatcagtggacttgcacctctctgtgatcagcttgttgtactttcgtatg

SEQ ID NO: 507 - DNA, 700 bp, Homo sapiens
  misc_feature (2)..(2): n is a, c, g, or t
  misc_feature (17)..(18): n is a, c, g, or t
  misc_feature (29)..(29): n is a, c, g, or t
  misc_feature (39)..(39): n is a, c, g, or t
  misc_feature (45)..(45): n is a, c, g, or t
  misc_feature (47)..(48): n is a, c, g, or t
  misc_feature (57)..(57): n is a, c, g, or t
  misc_feature (91)..(91): n is a, c, g, or t
  misc_feature (103)..(103): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (178)..(178): n is a, c, g, or t
  misc_feature (191)..(192): n is a, c, g, or t
  misc_feature (198)..(198): n is a, c, g, or t
  misc_feature (203)..(204): n is a, c, g, or t
  misc_feature (333)..(334): n is a, c, g, or t
  misc_feature (341)..(341): n is a, c, g, or t
  misc_feature (344)..(344): n is a, c, g, or t
  misc_feature (346)..(346): n is a, c, g, or t
  misc_feature (351)..(351): n is a, c, g, or t
  misc_feature (354)..(355): n is a, c, g, or t
  misc_feature (399)..(399): n is a, c, g, or t
  misc_feature (415)..(415): n is a, c, g, or t
  misc_feature (422)..(423): n is a, c, g, or t
  misc_feature (426)..(426): n is a, c, g, or t
  misc_feature (509)..(509): n is a, c, g, or t
  misc_feature (532)..(532): n is a, c, g, or t
  misc_feature (581)..(581): n is a, c, g, or t
  misc_feature (627)..(627): n is a, c, g, or t
  misc_feature (653)..(653): n is a, c, g, or t
  misc_feature (659)..(659): n is a, c, g, or t
  misc_feature (670)..(670): n is a, c, g, or t
  misc_feature (693)..(694): n is a, c, g, or t
  misc_feature (700)..(700): n is a, c, g, or t
tnacatgagaggtcgcnncaccaggaccntcacggatcntatttncnncacaaaagngaatcgtcgacccacgcgtccggcgccagggaantttttcccccanangggggngngagagccggaaagatggtggttaccagatctgcacgggctaaggccagcatccaagccgcgtccncccccagttccgnnaaaaanagggnngctgctaatgggattcaagcgcatccagaaagtagtactggatctgatgcccgaactactgctgaatcacagaccactgggaagcaaagtttaatccctagaactcctaaagctagaaagaggaagagnnttttttntgncnccccnccnnaggggactgaaccatctacggatggagagacctctgaggaaaanaaaaaatattctgtgngggggcnncgngataccattttaagggtaactaggagaaggcagatcttaattgcatgctccccagtgtccagtgttaggaaaaagccgaaagnaactccaacaaaggagtcttacnctgaagaaatagtgtctgaagcagaatctcatgtttcaggtatttctanaattgtgcttcccacagaaaaaaactacaggagccagaaagaagtnaggctaaatctctgacagatcccaangccaanaatctcatacngaagctatatctggatgcttgannacatcn

SEQ ID NO: 508 - DNA, 1295 bp, Homo sapiens
  misc_feature (681)..(681): n is a, c, g, or t
tcacccaaaacccccctccttagagatactatagaggatcgcatcaccatcaccatcacggtcgacccacgcgtccggaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggtaaaggaactctgcaggaagttgccacctgcacccatgatctgcatggggtagatgggaagccaagncaagttgccatccctattgccaagcaaatatttctcttgaattaaataattcatgttaatagggctggcatggccctacagggctagaatcaaactctggggatttggggaatgaataaaaagggggtttttcccatgaaatcaaaaaactacccccctttccctaaaaatttgggtaaacccccggaaagttccccgggaaattattttccttttttaaggttaaaaaaaacccggggggggggcggggggccccccctggaaccccccttttgggagggggggggggaaaaccccgggggggcgggatccaaacccccctccccacgggaacacccccccccccaaaaaaaaaaaaacacacgtggggggagagtccctaacccccctcggggagacggggcgcgaaattttttcccacgaggggggagagcgaacacaacacacctctcttctcacaccggagaagaaaaaaattcttcaacaaaaacatcattcattctcgccgatccacccactatacataacaccacccccaagccctcctacatccctacaaatcatacaccaaacccatccaaccccactctccaaacccaacaccacacccaatt

SEQ ID NO: 509 - DNA, 1202 bp, Homo sapiens
  misc_feature (7)..(7): n is a, c, g, or t
  misc_feature (906)..(906): n is a, c, g, or t
  misc_feature (958)..(958): n is a, c, g, or t
  misc_feature (976)..(976): n is a, c, g, or t
  misc_feature (997)..(997): n is a, c, g, or t
  misc_feature (1010)..(1010): n is a, c, g, or t
  misc_feature (1032)..(1032): n is a, c, g, or t
  misc_feature (1073)..(1073): n is a, c, g, or t
  misc_feature (1084)..(1084): n is a, c, g, or t
  misc_feature (1094)..(1094): n is a, c, g, or t
  misc_feature (1098)..(1099): n is a, c, g, or t
  misc_feature (1102)..(1102): n is a, c, g, or t
  misc_feature (1110)..(1110): n is a, c, g, or t
  misc_feature (1112)..(1113): n is a, c, g, or t
  misc_feature (1120)..(1120): n is a, c, g, or t
  misc_feature (1137)..(1137): n is a, c, g, or t
  misc_feature (1144)..(1145): n is a, c, g, or t
  misc_feature (1147)..(1147): n is a, c, g, or t
  misc_feature (1152)..(1152): n is a, c, g, or t
  misc_feature (1156)..(1156): n is a, c, g, or t
  misc_feature (1161)..(1161): n is a, c, g, or t
  misc_feature (1166)..(1167): n is a, c, g, or t
  misc_feature (1183)..(1183): n is a, c, g, or t
  misc_feature (1187)..(1187): n is a, c, g, or t
tagaganattactatgagaggatcgcatcaccatcaccatcacggatcctatttaggtgacactatagaatcgtcgacccacgcgtccgcccacgcgtccgcccacgcgtccgctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagccaagagccaggcccagaaagaagaaaacccaaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaactggttccaattttttggtcatttctcanaaaattaaaatacttataaaatcctatattttactttttggggggtattacntttaaaatttagaaatcntcagtccagtgaccatttttntgaaaagctgtanccctccaaggtctgggaatttntcgaaaagcttttgatgctctgcatttgttttcccttaggngaaaatgtagnaatcctcaangggnnttngaatttangnncccttcngttcccaaggttaaaanggggttnntntttcngggntttcncaacnntttttttaaaaaaaancttncaatttattttttaa

SEQ ID NO: 510 - DNA, 843 bp, Homo sapiens
  misc_feature (769)..(769): n is a, c, g, or t
  misc_feature (795)..(795): n is a, c, g, or t
agagagatactatgagaggtcgcatcaccatcaccatcacggatcctatttaggtgacactatagaatcgtcgactctggaccttggctgtcactcagttaagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagaatgatggaatagttcattttgaaacacgagaagccctgccnacgtgggataagcagatccaatcacntttgtttcaagtgaataactttttgagaaattagtcaacagcaccgaa

SEQ ID NO: 511 - DNA, 1205 bp, Homo sapiens
  misc_feature (3)..(3): n is a, c, g, or t
  misc_feature (961)..(961): n is a, c, g, or t
  misc_feature (967)..(967): n is a, c, g, or t
  misc_feature (970)..(970): n is a, c, g, or t
  misc_feature (975)..(976): n is a, c, g, or t
  misc_feature (986)..(986): n is a, c, g, or t
  misc_feature (995)..(995): n is a, c, g, or t
  misc_feature (1001)..(1001): n is a, c, g, or t
  misc_feature (1053)..(1053): n is a, c, g, or t
  misc_feature (1100)..(1100): n is a, c, g, or t
  misc_feature (1104)..(1104): n is a, c, g, or t
  misc_feature (1109)..(1109): n is a, c, g, or t
  misc_feature (1115)..(1115): n is a, c, g, or t
  misc_feature (1141)..(1141): n is a, c, g, or t
  misc_feature (1152)..(1152): n is a, c, g, or t
  misc_feature (1166)..(1166): n is a, c, g, or t
  misc_feature (1169)..(1169): n is a, c, g, or t
  misc_feature (1172)..(1172): n is a, c, g, or t
  misc_feature (1176)..(1176): n is a, c, g, or t
  misc_feature (1180)..(1180): n is a, c, g, or t
  misc_feature (1187)..(1187): n is a, c, g, or t
  misc_feature (1191)..(1191): n is a, c, g, or t
  misc_feature (1196)..(1196): n is a, c, g, or t
  misc_feature (1200)..(1201): n is a, c, g, or t
  misc_feature (1205)..(1205): n is a, c, g, or t
cantagagaaattactatgagaggatcgcatcaccatcaccatcacggatcctatttaggtgacactatagaatcgtcgacccacgcgtccgaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagagganagccanaanccagnnagccccaaanttccagtgnacaaancacgcacagaacctgggcgcgctgctgtgaaacgtcctgacctgtgatccantgacagtgagaaacaagtgcactctggttttttaaatttgctgaaangaanacagncgcccnctttttggtttaattgctataagganttttttggttnaaaacccctaatcntgnttntaangttncggtttncccngggantttnncctn

SEQ ID NO: 512 - DNA, 1333 bp, Homo sapiens
  misc_feature (836)..(836): n is a, c, g, or t
  misc_feature (1164)..(1164): n is a, c, g, or t
ggggaagcataactgacttacctataaataggcgtatcacgaggccctttcgtcttccctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggacgcgtgggaccgccacaggcccagaagctgccccaaagccaagcgccaagtctatctatgagcagaggaagcgttactccacagttgttatggctgatgtatcccagtacccagtcaatcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaaggagtgcagcgcgaccgctcgcccgccgctgagaccccgcccctgcagcgccgcccgtcagtccgcgcagtgatccgcaccgtanaagcggggcgccgggccgcggaccaaccccagccaaagcccattcccgaggcaaaggaagcgccaaagcctgaaaccgggggggaacctctaacaaccctgattcggcctccccggactgggaccccgggggtccctgactggaggaactcccaaggggaaacagaattgtaatatctcttaccacaacgtcaatacaatactaaaatctccttaccaaatctccatcactcaaatatatcacctccttgcacaccaaacaactaaaaatacggcttatccttatcatatcatcaaaatcatactcttatcgccattacctaaacacncaacatatccgtacactttcaccattctaaaagcatcacatacaacacaacctcctttacacatatctagtacaccggtcttaccattccagctcgcaacactctactgtaatcaatgcacacccacatccctcttcaccaaatcagccatcaactgaacaccacatac

SEQ ID NO: 513 - DNA, 1171 bp, Homo sapiens
  misc_feature (1)..(1): n is a, c, g, or t
  misc_feature (4)..(4): n is a, c, g, or t
  misc_feature (843)..(843): n is a, c, g, or t
  misc_feature (908)..(908): n is a, c, g, or t
  misc_feature (911)..(911): n is a, c, g, or t
  misc_feature (918)..(918): n is a, c, g, or t
  misc_feature (920)..(920): n is a, c, g, or t
  misc_feature (928)..(928): n is a, c, g, or t
  misc_feature (930)..(930): n is a, c, g, or t
  misc_feature (936)..(936): n is a, c, g, or t
  misc_feature (951)..(951): n is a, c, g, or t
  misc_feature (985)..(985): n is a, c, g, or t
  misc_feature (1029)..(1029): n is a, c, g, or t
  misc_feature (1037)..(1037): n is a, c, g, or t
  misc_feature (1048)..(1048): n is a, c, g, or t
  misc_feature (1052)..(1052): n is a, c, g, or t
  misc_feature (1069)..(1070): n is a, c, g, or t
  misc_feature (1074)..(1074): n is a, c, g, or t
  misc_feature (1077)..(1077): n is a, c, g, or t
  misc_feature (1088)..(1088): n is a, c, g, or t
  misc_feature (1094)..(1094): n is a, c, g, or t
  misc_feature (1098)..(1098): n is a, c, g, or t
  misc_feature (1105)..(1105): n is a, c, g, or t
  misc_feature (1108)..(1109): n is a, c, g, or t
  misc_feature (1115)..(1116): n is a, c, g, or t
  misc_feature (1125)..(1125): n is a, c, g, or t
  misc_feature (1128)..(1128): n is a, c, g, or t
  misc_feature (1132)..(1132): n is a, c, g, or t
  misc_feature (1140)..(1140): n is a, c, g, or t
  misc_feature (1142)..(1142): n is a, c, g, or t
  misc_feature (1148)..(1148): n is a, c, g, or t
  misc_feature (1151)..(1151): n is a, c, g, or t
  misc_feature (1158)..(1158): n is a, c, g, or t
  misc_feature (1164)..(1164): n is a, c, g, or t
  misc_feature (1166)..(1166): n is a, c, g, or t
ntantagagagattactatgagaggatcgcatcaccatcaccatcacggatcctatttaggtgacactatagaatcgtcgacccacgcgtccgctgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaaancaggagctgtggaaatatacgatcgacaatgtttccccccacgcacagccggaagaagaagaacnggnaacggcnantgttcaangnatcttnatggccggcaaaggnagtatctcaacagcctcgtaggcccgactttganatgactgtcccaggtgccctccggctctttgtaaatggaaaagntcgtttcnccccaaggctntgantatgaaaatctctacgnncccnttntttgaaaaatngccaantgtncctgggncanncccaanntttcaccanttnttangaaaaacnanacttgnccnccaaatncctggnanggaaa

SEQ ID NO: 514 - DNA, 866 bp, Homo sapiens
  misc_feature (745)..(745): n is a, c, g, or t
  misc_feature (798)..(798): n is a, c, g, or t
  misc_feature (803)..(803): n is a, c, g, or t
  misc_feature (817)..(818): n is a, c, g, or t
  misc_feature (866)..(866): n is a, c, g, or t
agatactatgagaggtcgcatcaccatcaccatcacggatcctatttaggtgacactatagaatcgtcgactctggaccttggctgtcactcagttacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgncaggactcatgggtgcagcagtgacgctcaagaacttgacaggtctaaaccancgtcngtgagaggaagggnngtatagctacatgcctagagaagatgagcggacagattgaagagcttn

SEQ ID NO: 515 - DNA, 429 bp, Homo sapiens
  misc_feature (1)..(2): n is a, c, g, or t
  misc_feature (147)..(147): n is a, c, g, or t
  misc_feature (257)..(257): n is a, c, g, or t
  misc_feature (265)..(265): n is a, c, g, or t
  misc_feature (289)..(289): n is a, c, g, or t
  misc_feature (297)..(297): n is a, c, g, or t
  misc_feature (301)..(301): n is a, c, g, or t
  misc_feature (303)..(303): n is a, c, g, or t
  misc_feature (333)..(333): n is a, c, g, or t
  misc_feature (336)..(336): n is a, c, g, or t
  misc_feature (345)..(345): n is a, c, g, or t
  misc_feature (350)..(350): n is a, c, g, or t
  misc_feature (384)..(384): n is a, c, g, or t
  misc_feature (387)..(388): n is a, c, g, or t
  misc_feature (391)..(393): n is a, c, g, or t
  misc_feature (395)..(395): n is a, c, g, or t
  misc_feature (400)..(400): n is a, c, g, or t
  misc_feature (406)..(406): n is a, c, g, or t
  misc_feature (409)..(409): n is a, c, g, or t
  misc_feature (411)..(411): n is a, c, g, or t
  misc_feature (419)..(419): n is a, c, g, or t
  misc_feature (424)..(424): n is a, c, g, or t
  misc_feature (429)..(429): n is a, c, g, or t
nntagagagattactatgagaggatcgcatcaccatcaccatcacggtatcctatttaggtgacactatagaatcgtcgacccacgcgtccgggcggccggccggctgcatggcgcgctgcgagaggctgcgcggagcggccctgcncgacgtgctgggccgggcgcagggggtcctgttcgactgtgacggggtgctgtggaacggcgagcgcgccgtgccgggcgccccggagctgctggagcggctggcgcggnccggcaangcgactctgtttgtgagcaacaanagccggcncgcncngcccgagctggccctgcacttcacgcgccncgnattcggggngctgntcaccatagcagctcttcaactccacgctgtgcnccnngannntnctgcnccaganaantnaccatggnctccntacgn

SEQ ID NO: 516 - DNA, 1339 bp, Homo sapiens
  misc_feature (1260)..(1260): n is a, c, g, or t
  misc_feature (1279)..(1279): n is a, c, g, or t
  misc_feature (1327)..(1327): n is a, c, g, or t
tactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgggccggtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcctccagatgctgaaggacgcaaaaagcctctacacagctgcacactgcgccccgctcctcaacctgaagctctcccacggtgactactaacggaaacgggccccaatccgcatgcgaactcgattaacttaacttggaaccctgtgaataaatccgaaatgacctccaaaccccactcggaattgttcaaaccctcggcgcccccggggctttttttttggggaaacccaaccaaccttgccaaatttccggacctagggaacctaatgggaaaaacactcccggatatccccgcgaaatatccccagccctccaaaaagcattaaggcgttcanacttccccaagaaccaacncaccccaccagcaacatccccgtttataaccctacaaaaaaaccaganttctacccacac

SEQ ID NO: 517 - DNA, 1296 bp, Homo sapiens
  misc_feature (1)..(1): n is a, c, g, or t
  misc_feature (876)..(876): n is a, c, g, or t
  misc_feature (879)..(879): n is a, c, g, or t
  misc_feature (915)..(915): n is a, c, g, or t
  misc_feature (937)..(937): n is a, c, g, or t
  misc_feature (942)..(942): n is a, c, g, or t
  misc_feature (953)..(953): n is a, c, g, or t
  misc_feature (956)..(956): n is a, c, g, or t
  misc_feature (966)..(966): n is a, c, g, or t
  misc_feature (1008)..(1008): n is a, c, g, or t
  misc_feature (1017)..(1017): n is a, c, g, or t
  misc_feature (1036)..(1036): n is a, c, g, or t
  misc_feature (1040)..(1040): n is a, c, g, or t
  misc_feature (1059)..(1059): n is a, c, g, or t
  misc_feature (1061)..(1061): n is a, c, g, or t
  misc_feature (1066)..(1066): n is a, c, g, or t
  misc_feature (1078)..(1078): n is a, c, g, or t
  misc_feature (1083)..(1083): n is a, c, g, or t
  misc_feature (1097)..(1097): n is a, c, g, or t
  misc_feature (1102)..(1102): n is a, c, g, or t
  misc_feature (1104)..(1104): n is a, c, g, or t
  misc_feature (1106)..(1106): n is a, c, g, or t
  misc_feature (1111)..(1111): n is a, c, g, or t
  misc_feature (1115)..(1115): n is a, c, g, or t
  misc_feature (1118)..(1118): n is a, c, g, or t
  misc_feature (1130)..(1130): n is a, c, g, or t
  misc_feature (1143)..(1145): n is a, c, g, or t
  misc_feature (1152)..(1152): n is a, c, g, or t
  misc_feature (1160)..(1160): n is a, c, g, or t
  misc_feature (1163)..(1163): n is a, c, g, or t
  misc_feature (1165)..(1165): n is a, c, g, or t
  misc_feature (1181)..(1182): n is a, c, g, or t
  misc_feature (1190)..(1190): n is a, c, g, or t
  misc_feature (1217)..(1217): n is a, c, g, or t
  misc_feature (1221)..(1221): n is a, c, g, or t
  misc_feature (1226)..(1226): n is a, c, g, or t
  misc_feature (1229)..(1229): n is a, c, g, or t
  misc_feature (1234)..(1234): n is a, c, g, or t
  misc_feature (1240)..(1240): n is a, c, g, or t
  misc_feature (1242)..(1242): n is a, c, g, or t
  misc_feature (1250)..(1250): n is a, c, g, or t
  misc_feature (1254)..(1254): n is a, c, g, or t
  misc_feature (1258)..(1258): n is a, c, g, or t
  misc_feature (1262)..(1262): n is a, c, g, or t
  misc_feature (1282)..(1282): n is a, c, g, or t
  misc_feature (1284)..(1284): n is a, c, g, or t
  misc_feature (1292)..(1292): n is a, c, g, or t
  misc_feature (1295)..(1295): n is a, c, g, or t
naaatagagaaattactatgagaggatcgcatcaccatcaccatcacggatcctatttaggtgacactatagaatcgtcgacccacgcgtccgcccacgcgtccgcggcggcgggagcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcanaantggaaatgaagagctctgaaccatccggtagtttangtctctcaaattactctgggtnacaanaaaaactgcanganctgcggaacnctaccatttcctgaatgaagaataccgggccctgcaggaaancaacagcancctcccggggcaacttgcnaatntggaaatgaaaggaccccnanagcanccaaaaatggcntcatnccaaacctgatttnacctncncnaattncaanttnaaaattgatttnttaaaccctatcnnnaatgccntttttacnccncncctccgattctaaaannaatctttnctttaaaaaatttccaaattttttttnattnaaaantcncctcnccccgncntaaaaaanaaancctncaanaactcatttccaaaaagttntnttttaacnccna

SEQ ID NO: 518 - DNA, 817 bp, Homo sapiens
  misc_feature (1)..(3): n is a, c, g, or t
  misc_feature (716)..(716): n is a, c, g, or t
  misc_feature (740)..(740): n is a, c, g, or t
  misc_feature (758)..(758): n is a, c, g, or t
nnnaatatagagaaatactatgagaggatgcatcccatcaccatcacggatcctatttaggtgacactatagaatcgtcgactctggaccttggctgtcactcagttacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccggcttctattgtggctgaagcctacgattttgttccagatgggctgnaatttataccagcagtgattctanggagactttattacttgnaagatttagcagcaagggttataagtcagtatatttgagagatttcaaaatataacaca

SEQ ID NO: 519 - DNA, 700 bp, Homo sapiens
  misc_feature (650)..(651): n is a, c, g, or t
agagatactatgagaggtcgcatcaccatcaccatcacggatcctatttaggtgacactatagaatcgtcgactctggaccttggctgtcactcagttaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtggcggtcggtcgttctgccccccagggcaccccctgttgtaggctggnntaagggaagggcaggccctcctttctgcccctcgagacactcttgggag

SEQ ID NO: 520 - DNA, 1209 bp, Homo sapiens
atgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaat

SEQ ID NO: 521 - DNA, 2655 bp, Homo sapiens
atgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagc

SEQ ID NO: 522 - DNA, 646 bp, Homo sapiens
  misc_feature (10)..(10): n is a, c, g, or t
  misc_feature (29)..(29): n is a, c, g, or t
  misc_feature (31)..(31): n is a, c, g, or t
  misc_feature (33)..(34): n is a, c, g, or t
  misc_feature (37)..(37): n is a, c, g, or t
  misc_feature (39)..(39): n is a, c, g, or t
  misc_feature (380)..(380): n is a, c, g, or t
  misc_feature (424)..(424): n is a, c, g, or t
  misc_feature (462)..(462): n is a, c, g, or t
  misc_feature (505)..(505): n is a, c, g, or t
  misc_feature (546)..(546): n is a, c, g, or t
  misc_feature (564)..(564): n is a, c, g, or t
  misc_feature (628)..(628): n is a, c, g, or t
taaaaattantttgctttgtagcggatanantnntantngattaattgtgagcggatacaatttacacagaattattaagaggagaaattactatgagaggatcgcatcaccatcaccatcacggatcctatttaggtgacactatagaatcgtcgacccacgcgtccgggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcanagtgacccaacaggagaagaccccaccgcctagacccagcccgntagaggcaggcagtgatggctgtgaggagccgaagcancaggtgtcttgggagcaggagttcctggtgggcagcagcccangaggcagcgggcgggcactgtgcatggtgtgtggcgctganatccgggcacccttcggncgacacagctcgctcgcacatcttggagcagcaccctcacaccttggacctgagcccttctganaagagcaatatcctggaa

SEQ ID NO: 523 - DNA, 936 bp, Homo sapiens
  misc_feature (1)..(6): n is a, c, g, or t
  misc_feature (768)..(768): n is a, c, g, or t
  misc_feature (866)..(866): n is a, c, g, or t
  misc_feature (881)..(881): n is a, c, g, or t
  misc_feature (893)..(893): n is a, c, g, or t
  misc_feature (896)..(896): n is a, c, g, or t
  misc_feature (899)..(900): n is a, c, g, or t
  misc_feature (903)..(903): n is a, c, g, or t
  misc_feature (905)..(906): n is a, c, g, or t
  misc_feature (908)..(909): n is a, c, g, or t
  misc_feature (921)..(921): n is a, c, g, or t
  misc_feature (931)..(932): n is a, c, g, or t
  misc_feature (935)..(935): n is a, c, g, or t
nnnnnnggcgcggggccccctaagaatactagagaggatcgcatcaccatcaccatcacggtcgacccacgcgtccggacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggtgagcaggggcgtggaaacctgctggaagggtgggggacaaggtggagcccagtttgggcttggaacgctgggcgtgtgtcgntgggtgagagtccaaaaacctgaagatccagcccaggaagcccctcgggaacgggaaagcttgcctggaacgcggcagtgggtggccccggctgccgnaaaccctgaaatggngaaactctgggnccnggnnggngnngnntaaaaagatccncctaaccccnnccnt

SEQ ID NO: 524 - DNA, 1179 bp, Homo sapiens
  misc_feature (1)..(1): n is a, c, g, or t
  misc_feature (914)..(914): n is a, c, g, or t
  misc_feature (926)..(926): n is a, c, g, or t
  misc_feature (956)..(956): n is a, c, g, or t
  misc_feature (964)..(964): n is a, c, g, or t
  misc_feature (977)..(977): n is a, c, g, or t
  misc_feature (1002)..(1002): n is a, c, g, or t
  misc_feature (1006)..(1006): n is a, c, g, or t
  misc_feature (1008)..(1008): n is a, c, g, or t
  misc_feature (1010)..(1010): n is a, c, g, or t
  misc_feature (1072)..(1072): n is a, c, g, or t
  misc_feature (1074)..(1074): n is a, c, g, or t
  misc_feature (1084)..(1084): n is a, c, g, or t
  misc_feature (1090)..(1090): n is a, c, g, or t
  misc_feature (1092)..(1092): n is a, c, g, or t
  misc_feature (1099)..(1099): n is a, c, g, or t
  misc_feature (1103)..(1104): n is a, c, g, or t
  misc_feature (1110)..(1110): n is a, c, g, or t
  misc_feature (1112)..(1112): n is a, c, g, or t
  misc_feature (1119)..(1119): n is a, c, g, or t
  misc_feature (1127)..(1127): n is a, c, g, or t
  misc_feature (1133)..(1133): n is a, c, g, or t
  misc_feature (1135)..(1136): n is a, c, g, or t
  misc_feature (1146)..(1146): n is a, c, g, or t
  misc_feature (1156)..(1156): n is a, c, g, or t
  misc_feature (1166)..(1166): n is a, c, g, or t
naaatagagaaattactatgagaggatcgcatcaccatcaccatcacggatcctatttaggtgacactatagaatcgtcgacccacgcgtccgatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaaagacggccgtgtgcgacatcccgcccgcggcctgaanatgtcggccacnttcatcggcaacagcacggccatccagganctgttcangcgcatctccgancagttcacggcatgttccggcgcanggcntncntgcactggtacacggcgaaggcatggacaaaatggatttcccgaggccgaaagcaacatgancnactggtgtcnaatacnancattacnagannccccgncnaaaaaangggaattnaagaanannagggcaaganaagcttaatnccccccaaanggttaggaaacga

SEQ ID NO: 525 - DNA, 1926 bp, Homo sapiens
atggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattag

SEQ ID NO: 526 - DNA, 1311 bp, Homo sapiens
atgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctag

SEQ ID NO: 527 - DNA, 1271 bp, Homo sapiens
  misc_feature (1)..(3): n is a, c, g, or t
  misc_feature (501)..(501): n is a, c, g, or t
  misc_feature (580)..(580): n is a, c, g, or t
  misc_feature (607)..(607): n is a, c, g, or t
  misc_feature (620)..(620): n is a, c, g, or t
  misc_feature (628)..(629): n is a, c, g, or t
  misc_feature (639)..(639): n is a, c, g, or t
  misc_feature (648)..(648): n is a, c, g, or t
  misc_feature (662)..(662): n is a, c, g, or t
  misc_feature (769)..(769): n is a, c, g, or t
  misc_feature (771)..(771): n is a, c, g, or t
  misc_feature (830)..(830): n is a, c, g, or t
  misc_feature (832)..(833): n is a, c, g, or t
  misc_feature (846)..(846): n is a, c, g, or t
  misc_feature (857)..(857): n is a, c, g, or t
  misc_feature (860)..(860): n is a, c, g, or t
  misc_feature (871)..(871): n is a, c, g, or t
  misc_feature (876)..(877): n is a, c, g, or t
  misc_feature (884)..(884): n is a, c, g, or t
  misc_feature (892)..(892): n is a, c, g, or t
  misc_feature (896)..(896): n is a, c, g, or t
  misc_feature (903)..(904): n is a, c, g, or t
  misc_feature (906)..(906): n is a, c, g, or t
  misc_feature (931)..(932): n is a, c, g, or t
  misc_feature (944)..(945): n is a, c, g, or t
  misc_feature (951)..(951): n is a, c, g, or t
  misc_feature (956)..(956): n is a, c, g, or t
  misc_feature (991)..(991): n is a, c, g, or t
  misc_feature (999)..(999): n is a, c, g, or t
  misc_feature (1003)..(1003): n is a, c, g, or t
  misc_feature (1012)..(1012): n is a, c, g, or t
  misc_feature (1043)..(1043): n is a, c, g, or t
  misc_feature (1076)..(1076): n is a, c, g, or t
  misc_feature (1102)..(1102): n is a, c, g, or t
  misc_feature (1171)..(1172): n is a, c, g, or t
  misc_feature (1203)..(1204): n is a, c, g, or t
  misc_feature (1207)..(1207): n is a, c, g, or t
  misc_feature (1264)..(1264): n is a, c, g, or t
nnnaagatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggccgtccccgggctccaccgcgcccgcagcccacggtgtcacctcggccccggagagcaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggggtcacctcggccccggacaccaggccggccccgggctccaccgcccccccaacccacggggncaccacagccccggacgacaagccggccccgggcaccaccgcccccacagcccaaagggacacacggcccccgacaacnagccaggcgcagaaaccaccagcaccncaacccaaaaagnaaccacgnncacacgaccnagcacaaangaagcacaacaaanaacgggccacaaaaaaaaacgaaccacggaagaaccacaacggaaaaccccaaggcccggaacaaaggaaaaaacaaaaaacagaaaggaccacacccgaaacacananagaccgaaaaaaaaaaacaaagccacaccccaaaaagacccccaaaaaacaccacaccncnnaacaacaaacaancccacacgacnaancaacccaaaanaaaannaaacacnaacagaanaacnaaacccnnanaccccaaaaaaaaaacccaacacanncaaaaaaaaaannaaaaanccaancaacccccaaaacccgacacaaagacaacaaaacnaacacccncccnagacagccnaaaaaaaaccagcacaaacaacaacccaccncccaccaacagaaaaaaaacgcacgaaacccanaaacaacaagacacaacacacaaacnaacaaaacaaaaccgcccaccccgaaaaaccccacaaagcaacacacccaccccagcgaaagcaaaacnnaagacccaaccagaaaacacccaaacaacannganacacccgcacgacagaacacgaaacacacaaaacccaccaaaagccaacacaacaancacaaca

SEQ ID NO: 528 - DNA, 10831 bp, Human
agtttgcggcactgttgtcatttccggggtaagatggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgagtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcaggaaagaataaatcagccaggtgtgatgacttgtaactgtaatcccagttataggggaggctgaagcaggaggatcacttgaggccaggagtttgagaccagcctgggcaacatagtgagatcccatctcaaaaaacattatttttaaaattagcctggtggctcacgcctgtaatcccagcactttgggaggccgaggtggccagatcacctgaggtcaggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacactttgtctcagaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatcttaccactattaacattttgatgtatctatctgtatgtatggctattcttttttgttaaaacatgatcatagcatatctactattttattatttgatttttaaaatttaacattatattatgggtaaccttacatgtcaataaacaattccacattgtcatgctttaaatggctgcataggctgggtgtggtggctcacgcctgtaatcctaccactttgggaggccaaggcaggtagatcacaaggtcaggagttcgagaccagcctggccaatatggtgaaacctcatctctattgaaaatacaaaaatcagccaggcacggtggcaggcgcctgtagtccacctactcgggaggctgaggcaggagaactgcttgaacccagcggcagaggttgcagtgagccaagattgagccactgcactccagcctggtgatagagcgagactctgtctctaaataaataaataaataaataaatgtctgcatagtattccattgtatgcatttattatacattcaaacattaaacatctaccataccaatcatggttctaagcatacagtagccaccttcatgcttccttgattgggcttacagtctagtaaggagacagatattaaataactgcataaaacactgttcttggtaggtaataacccagatgctatgagccatccagtaaaggttaccgatcttatctggaaggatcagaagatggatgtcccataatttaaccaattatctattgataggcatttattgagttttaaatgaataatgacatgatcaataaaaatgtcctcctcacttaaagaatagaaaaaccaggagaagggagttctgaaataagtaagtatgtaggtccagcatcaatggctcaagatactctattcccaaataacccttaagttatctggttctattccaacccttgggtattactatcttctctttggtctcatgcattgagaattcagcaaaggatttgttccctacagtgtgcacggcccttaggatagcaggattccctgaagagggccaaaggggcaggagcgcagccttagtggcagtgctggtccatgaggctctacaaagcaagggatgggtgtttgggaggaggaaaaggctcttgctgtactcctagaggttggaattaaagtggaaaagccagaaaattcaagtcctttactaacatgtctggagattagaaggtatatgtacatgggggagaagccaaaattattgctgcgagtggtcagcaagaaaatcaaggctcttttcattattttgagcattcctctgatatttgaaaaggaagtacaacaggaaaggaagtctgaggatggaagctaaaattggtatgaatttatattttagagatcaaaatgtaccttatgttgaaacctatgtaagaagtgattatgtagaaagagtgaaagtgatagctcttagtctggaaagcccactggcttgtttgggcatttctcatggcttcccactcaaagtggatccccaaaatcacttgatggatttccttgctgatttctaagtaaactatggtttaagaaagaaatgacagggctcagcactgccctacagtaccaagaatacaaatgtttccatgaagtcttcaaaggcatttgtaaaattcaggctgtaagtgattagttagttcattctgcacttatttattaactgtatattcagttccaggctctagggtagagattatggataaaggtgaattagatagatgaagtttttgccctcacagcaaaagctttagccaataattaaagctatcactggaagtgggtctgtgccaataacctagagaagagcagtgcttttagagttgagctatattcccaatcagttcttaatggtggttttacccccttccctctacactgtcttttcttgagattggatcatgtgtgtgaacccacatcatttccagtcaaaatcaccaagagaggccggacacagtggctcatgcctataatcccagcactttgggaggcctaaatgggtgggcctcttgagtccagagtttgagaccagcctgggcgaccccagctctaccaaaaaaaccaaaaaacaaaaaataccaaaaaaaaaaaaaattaggccgatgaagtgacatgcacctgtgtgccacctactcaggaggctgaggtggcaggatcacttgcatctgggggcaaaggctgccgtgagctgagattgtgccattgcgctccagcctgggcgacagagcaagactctgtgtgtgtgtgtgtgtgtgtgtgtgtgtgtgtgtgtgtgtgtgtgtgtgtgtgtgtgtatacacacacacatatatatacacacacccccaggagaccttttgtctttcttggttcatgtgcccatcagtgtgggcaggagaatagaatactctgtccacacttgagtcttagtcacctttggagcctaggagtcagccatcctcattcaactacatggatcgagaatgggaatctgggagaatttttttatgggcagattaaaaaggaagttaactatgtaaagtaaggcattgccttcccaccccatcccacctcagttcgtgttaaattatgaatttttctaagagagttctttaatgacatggatagagaggaagctgaggtggcagtagagtagggagtggaaggcaaatacataagatactattaaactgtgaagctgtttgttacaattccaagattttataatttctccaacaaaaaacatttgtattttcttcccagtttaagttcaatgttaatttgagaaataattctactctcaaacttcatgttatgctgacagttcaactgatgctgtcaaaatgtgaattactaacttcagtattctctattcatctgatttttcttaaaatgtttgcgtgttaatatactcactagctttaatgctctactcttatactggcaccttaattatggtaaaaggtaaaaggttaagttaaaattcccaatcctagttatttggtcaaacagaagattaacagaactccatggcttaccacaggaatatttatcaagagaaaaagaagatacctatttgaatttacatgacactttctgtgaaatatctggattaccagattagtctgaaacaaatgccttccaaattctacagcgcatgcccaaggcactctttacagtacctgttcgggtcttttcttctaattttaagcacctacccaaacgtcttcccaggcttgtcataataagcaaataacctcagagcagacaaagtgattcaatctaagaaccttgaatttctctccttttcacctcaaaatttctattctcacactttctttttgtttctctttccgagaagtggttctccatcagcaaataccaactgttttctgtcctctattatttattccatctcttcctcctgatccctgccccatgttgaacccccattgccccactttgatccttcagtctcttcctcacatccagaactgtaccagatttactcccttagcacactgattaaaatttatttccatttccttatggaggaggtattagagactgatcccagacctctacaaatttcattgtggcagggtaatgttatgtgtccataaaccttgttccttttctttcagcctgcagttaggtagagccatgtcatttatttgtaactattagaatatgggtatatgggttgaagtaatgtaggccatttccagacatggcccataacacttctcaagagattcttcatattctatctcttcccctccaacatgcacccttcaaggttgaagatggcaccacacaagatagaaggagccagtgttccaaatgactaggcagagcagaatgctcccctccctacaccctagcaccaattggtttggatgtgatagttgaataatacacttttattgttttaagacattaatattttgagattaatctgcaagtctagttagtaaaactcgaactctgagctgtctaatgcagtagcctctagccacatgtagctatttaaatttaaattttaattttaattaatcaaaattcaactcagatatactagccacatttcaattgctcagtagccacactaattaaatttaaatttaaatagctacatgtggcttatagcaccataccagatagcacagatgtagactgtttccatcatcacagaaaattctattggatagtgctgccttaactaataagacacaaatgttcttattttttaaatagtccctaaaacaaacgaaaaacaaagaactcccttctctaatggcaaatttcagtttgcctaaaagaagactcagaatgcttttcttatattgttacctctgactgccactaaatgaataaatttcctgtcttgctccttctgccaaacttcttgaatgggtgatctttaactccttgcaatcctggcttttttccccagtgctcacctgtaatcagtgttggccacaactcccacccagatgtctcctaaatagttctctgaacccacctctgtcctgatctacagacattcattccaatgctttagcatttcaaggtcatcaaatgactcagtgacatctcagacagtcagacagaccaggtcaactatgaactatttatgccaaaccttacatggttcatgttatccttgctatcccatcaaaataaccacaggctttttttttttttttttttaatttttgagatggagtctcactctgtcaccccgactagagtgcagtggtgcgatctcggctctgctcactgcaacctccgtctcctgggttcaaacagtgctcattcctcaactcccaagtagctgagattacaggcatgcaccatcacgcctggctaatttttctatttttagcagagatggggtttcgccatgttggccaggctggtctcgaactcctgacctcaagtgatctgcccgcctccacctcacaaagctttgggattacaggcatgagccacggtgcctggcctgcagcctcctttattttacaaaaggcattaccacttaaacactgaagatagcacgaatctctgatgtttgcaagttcagaataaaatggaaatgaaaattcattatgtggcagtctcagtactgagcacaaaggcttttaaccacaagcaaattactgtgctagccagaccgtgtgagagaactccaggccagcttgctaaaactgagcaggagaatttggagagagtccagaggagagccacagaaacaactgaagcatgacaagaataattgcagttctgttatagagaggtcatctatatcaggcttttatggagtaccatgtggaatgttaccacgcagagcatggggaacagctgttgtgactcaacaagagacaggacagaagaaatgagaacaggtggaagatcaataatttaggtttgatatggggaaagatggaacagtcaaagggattcacactgatttttggctgagcagaaggcagagtctcctccaacgggcaatgtaagtgcccccactcatctacaccccgagaagagccatcaaactgtattaaacttggaaaaagctatttaacttcaagtgtgctgcgagaaaacttcataatagttcctaagatgtgctaaaaagtaaagtccaaaaagatcataaagtctgtagagaagttctaagagtgcagtcagctataaaaacctagcaatttaatttcttagaaaaatgtagctggagttcaaactgtagtaacaaaggcaagtaaattaagttgtgggcaggtgtaattaagttaataggaatggcagggatgaatataaatcagaacaggactaacagtttgaaacattagatattcaaatgctcagagctgatgagccgagccactacgctaacaactctgcaaaccaaaggtttcacaaattgcacaagaacctggcctcgatcccattgtgttgctggcataagattagaagggcctgttggttcaattgttgctttggacagaggaggacaaacttgccacagtgaagaaatcatttttaaaaaccaccactgtcctttagtgcactaatttctctaataactaggtgtatattagaaataatgatatataagtgcagtatactccagtttcaacagaatggtgtcacttctgtaaaatgttgattttcagattgtcatactttctaaatacaaaaatttgtcacagcttccacatttacaagatattaaacattccataaaatatttgtagaaatatgaaaaaccaatttttgtagttgccttttgaaatgtatacaaaatatcccacatgggcaacatggtaaaacctcgtctctacaaaaaaaaaaaaaaaaatacaaaaagttagccaggcctggtggtgcacgcctgtggtcccagctactcgggaagctgaagtgagatcacctgtgcccaggaggtcgaagctgcagtgagctgtgattgcaccactgcactccagcctgggtgacagagtgagactttgtctcaaataaacaaaaagagacatatacaaaatatattagaaagttgggttaatatcctacaaacaaagtattacatagtttgcacaggattatgtgtgtaaaaagttttaaattcagtatagcttttatttctgcagaactaaaagtagtgcataaaaataaaagtgggatgagcatatctttttaatttgctatgcagtaaaaagtatctcagtcaacatataggaaaccagtgccatttctgtatcatttgacaccgaaggggtattgttttttgttttgttttgtttttcttttgaagaaagacttttatgtcttttattctattcttccgatttggggtttaaattacccccaataagtttgcagaatattctgattactactgcttaggtgatatatttcatatgagaactatctttacacaatgggaaaaaatatggtaaccacttcattcatcagagaagttgtgttttgtttacttgtattttgtttgctaaatgaaattggttatttagactcatggcatgctttttctcaaatggagatttaaaagtcatttccaatgtccttctaacttctggccaattcccagtaggctatagaataaacagttttcatataataaaaaaaaaaaaaaaaa

SEQ ID NO: 529 - DNA, 4352 bp, Human
acaaacctgaaacgaaatctttgcaaccagtacagcctgcgcggggcgcggcccagtccatcccccttcggatgcgcagaagcagaggtcaccacgccggacccctcgattccctcgcgggcgattcctggctccttcaccaccccagcactccaagacccccgccctttggcctgaggctcccactgccctagccagttcccgggctcacttccagcttttccagaaagcttggccacgcccctcggcccagactctcaggccactcggccgcaattaacccgcgtctctgcgcctttttaggcccctccccctcggtcgtgcccttgtcatctcttaggccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaaaaaaaa

SEQ ID NO: 530 - DNA, 3172 bp, Human
agtgctgggcggggcgctgactcacccgggcccgggctggccggttcttaagcggcagcgcgctgcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagcaaaaaaaaaaaaaaaaaaaaaaaa

SEQ ID NO: 531 - DNA, 487 bp, Human
gattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgca

SEQ ID NO: 532 - DNA, 1941 bp, Human
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaaaaaaaaaaaaaaaaaa

SEQ ID NO: 533 - DNA, 3666 bp, Human
agtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcatta

SEQ ID NO: 534 - DNA, 2943 bp, Human
aactcccaagccccacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacacttaaaaaaaaaaaaaaaaaa

SEQ ID NO: 535 - DNA, 1229 bp, Human
gtctgacgggcgatggcgcagccaatagacaggagcgctatccgcggtttctgattggctactttgttcgcattataaaaggcacgcgcgggcgcgaggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtaaaaaaaaaaaaaaaaaaaaaaaaa

SEQ ID NO: 536 - DNA, 512 bp, Human
cctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 537 - DNA, 511 bp, Human
ggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaaaaaaaa

SEQ ID NO: 538 - DNA, 4454 bp, Human
agaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttca

SEQ ID NO: 539 - DNA, 1940 bp, Human
gcggttcggcgcggaaagcgggaggtggaggggcggcttggggcaagcgcgcgcgcgcagtgcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgatagtgggcaaaaaaaaaaaaaaaaaa

SEQ ID NO: 540 - DNA, 1153 bp, Human
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgc

SEQ ID NO: 541 - DNA, 1326 bp, Human
cagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 542 - DNA, 2050 bp, Human
agacgctgtggtctcacctgtcctggcaaggggcctctgccggctgttcccatgactggctcagggtctgagttcttattccatcaaccttgatcaaaagaaggaaagggaagaaaaaggcccagggaggctgaatgaatgtatttcaccagtagcaaatgagatgaaccatcttcctgcacacagccacgatttgcaaaggtttttggagaggaataaatttaatgaaagatgtacatgacttctaaaaactataagcagtgctgggtaaaattaaacacatgatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttaaaaaaaaa

SEQ ID NO: 543 - DNA, 10074 bp, Human
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctccaaaaaaaaaaa

SEQ ID NO: 544 - DNA, 1719 bp, Human
gctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaaaaaaaaa

SEQ ID NO: 545 - DNA, 4186 bp, Human
gttcttggggcgtgggcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccaggcgcggtggcttacgcctgtaatcccagcactttgggaggccagggcgggtggatcacgaggtcaagagatcaagaccatcctggccaacatggtgaaaccccgtctctactaaaaatacaaaaaaattagctgggcgtgatgatgtgcgcctgtagtcctgtctactagggagactgaggcaggagaatcgtttgaacccaggaggcagaggttgcagtgagcagagattacgtcactgcactgtagcctggcgacagagcaagactccatctcaaaaaaaataaaaaagtacaaaaagtacttgcttttatattacatcataagcagtagttaataaagttgtatactcttaagaggtgggcattatgattattttttatttttttattttttatgagatggagtctcactcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtgatttctggataacatttcttatgaaaaa

SEQ ID NO: 546 - DNA, 1946 bp, Human
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtgaaaaaaaaaaaaaaaaa

SEQ ID NO: 547 - DNA, 2050 bp, Human
gggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagagccttgcaaaataccctactaaataaatcattttagacatggagtgcaggtggacactgtgtgaactgtttttggtcagttattgtagaaattgatagatgtaccaaataaactctatgcacattaaaaaaaaaaaaa

SEQ ID NO: 548 - DNA, 2151 bp, Human
gcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactcaaaaaaaaaaaaaaa

SEQ ID NO: 549 - DNA, 3448 bp, Human
acggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaaaaaaaaaaaaaaaaaaaa

SEQ ID NO: 550 - DNA, 5653 bp, Human
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaaaaaaaaaaaaaaaaaaaa

SEQ ID NO: 551 - DNA, 3167 bp, Human
aggggcgttgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcagtgtgtagagtggaaaaaaaaaaaaaaaaaaaaaaaaaaaaaaaaaaaaaaa

SEQ ID NO: 552 - DNA, 3363 bp, Human
gctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtggagagatggaaccgccatgatcagaagctgctggaggcagtgcacaggggggatgtgggacgcgtggctgccctggcctccaggaaatctgcccgacccaccaagcttgactcgaatggccagtccccgtttcatctggcagcctccaaaggcctgacagaatgtctgactatcctgcttgcaaatggggctgacatcaacagcaagaatgaggatggaagcactgccctacacttggccaccatctcctgccagccacagtgtgttaaggttctgcttcagcatggtgctaatgaagatgctgtggatgcagaaaaccgtagtccattgcactgggcagcctcctctggctgtgcctcaagtgtgctcctgctgtgtgaccacgaagccttcctggacgtgttggataatgatggacgtacacccctgatgatcgcatcgctgggtgggcacgcagctatctgctcacagctgctgcagcgaggcgcccgagttaatgttacagacaagaatgacaaatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtcagaggctagtccagcacccagatctcgcatcccaggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggg

SEQ ID NO: 553 - DNA, 1549 bp, Human
gccatccgccctccacacgattcagcccggtggtgttagccccctggactcgattcctgaggcaaacagtgccccttaaggtcggcgacagcctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcactggccgtgaagcgttcacaccggcgcctcggcctggcccagaagctgatggaccaggcctccagggccatgatagagaactttaacgccaaatacgtgtctctgcacgtcaggaagagtaaccggccagccttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaagcatttcaggtcctcatgtctcaaccacatctactctgtgaaccctggcttagtctgtctgctctgcagcatctgctgtggggatcatctcacagtgaccagaatggcttctcactcttaactctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttctccttttagaatgatgaacaggaagcagggcaaactcttgaagatttccagctttcagtttttgtttttgttttttaaccattatttacctgagttttcatccttgaggaggtgaagtagtcaggaccatgaagtcagacctcatgccctcttcctcctctttcctggaagaagtattcagtttccttttcctttctctggtaactcctcctttatactattcccccctcccttttttttgaggaggagggcatcaccttcccagtgggaaaaggtgttaagttaggagcttctactgtacaatcagaacttggagattttaagaaaaggacaaacggtaattaaattggaatctctaaaaaaaaaaaaaaaaaaaaaaaaaaaaaaaaaaa

SEQ ID NO: 554 - DNA, 7224 bp, Human
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 555 - DNA, 1969 bp, Human
tgaggtttggtctctgttgtcacaacattcagtacaatctgctgcccaggacctggacattgacagataaaatgaagtgggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaaaaaaaaaa

SEQ ID NO: 556 - DNA, 1082 bp, Human
ccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaaaaaaaaaaaaaaaaaaaaaaa

SEQ ID NO: 557 - DNA, 1557 bp, Human
agcgacaggccccgcccccgccaaccgcctcgcgccttccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaaaaaaaaaaaaaaaaa

SEQ ID NO: 558 - DNA, 1068 bp, Human
cgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttgggaaaaaaaaaaaaaaaaaaaaaaaaaaaaaaaaaaaaa

SEQ ID NO: 559 - DNA, 691 bp, Human
gacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 560 - DNA, 6025 bp, Human
gtagaggcggaagttgaggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaaaaaagagagcgatcattgtgttaagttatgtgggtgttttcatcagctaggagcaaggctgtggaataaggagtcagattctcagcttgctttcactttcaaggacttacagaggagtagtcaccagcctcacagcagaagttcagcccggcccccaccgcttcccccagcctaccccatagaaacgggctttgggctgacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggtggcacgcgcctatactcccagctacttaggaggctgaggcaggagaatcacttgaacccgggaggcagaggttgcagtgagccaagatcacaccactgcactctagcctgggcgacagtgagactccacctcaaaaaaaaaaaaaaaaaaaaaaaaaaaagtcacgctgggcccctctctacagggggacacacaggcttagtttagtatatgtctaaccagattttgcatgtcaagcatttgtccttttcctggcttatgttttcttgtagaaattatataaaccctatcaaatccactactaggtaaatttttaaaccatgcagctttattactctcctcccccaaagaatgtagtttgaaattttctcatttccatagtagaggccctaactgccattgtattactaataatgcaacatgaaattgaaggtgcctaactgctcaaaaaacaaaatcagccatcatactgtaactctgagaggaatgagaggtggcacaggcacgagtgggctcagcccgtgtgagtgaggagaactgaggaatcctagggtgcgcatcctgcatcctggctgcacgtttgctgcagagtatgtttttctttcttgcctcccttcagttttcttcagttgcgttcagtgtatcttctggaaccaatagtgccctgtgttctcaagtctctaaaatgctaagatctgagcaaagtcaagcagcttacactaggcttttttacagctgtgcttgagaacatttccgagtggaccagggccttgaggagcctgtttttcagcaaattcaacagatgtgtgcagtgattccctccgttttgtatttgacaccttcatttaaaatgctaagatgcaatatcattcacttcaaagtggggaaaatgcagaattgtgtttcctttttatctgtgtgattccttaagaaacatgtttttaaaatatgtgttctaaatggttttttattctgtattactgctttggccatgtggctctcatgactttcattgtaccagattctcagctccctgaaacatggggacgagaagctctggaattacagcaagatttttgttccatgagcgcaatactgtatcattaacatttttaatggtatggattttatagcatctgtgtatgtttgcaaatattaagttattacatgttttaaaatgagcgtttttcatcttaaattttatatgtttgcaaatatatttttttaataaaatttcaaaaccaagttttagcacctactaaaaaaaaaaaaaaa

SEQ ID NO: 561 - DNA, 3422 bp, Human
gtcccggcggccattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacg

SEQ ID NO: 562 - DNA, 2548 bp, Human
attccacagcggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacggcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaacaaa

SEQ ID NO: 563 - DNA, 9300 bp, Human
gcggggcgggtcgcgctggtccccggccggccggagcggcggcggtggcggcgcgaggcggcatgagggagccgctcgtgctgggtcctgccaccaccatggttccagtggttgagctttgctgaagcccaggcatcatgtacagtgtagaagacctcctgatctctcatggatacaagctgtcaagagaccccccagcatcacgcgaggataaccccaaggggcgccaggcagcgaggactgggacacgagcaggccagggcctgcagaacgggcatgaggatggccctgcggccctcgcacatcgtaagacgtccgcggggaaaggacatgtgagtgactccgaaagccgccgcagcacaccgagaggccacggggagccccagagcacttctgcttccagaacctcggaggcggggttttgtaatcaacccccctcagcatggtcctctcatcccccgactggtaacgaccaagcctaccggagaagaggacggcaagaagccaggagccagaagccgagggagcacgaaaacctggaggccagaggaatggcccaagcccacagcctgcctgtccacgtgagggagggtccatgggaagttggaggaaggtcagagcatgtgatgaagaagccagtttgggaagaagaattgcgaatgtcaggtcctgccaagtggcagaacgtcagcctggaaagctggaaccagccaaggaaattagggaggcagatgtctgatggagatggggagagactgtttcaagacctgtacccattcattcaaggagaacatgtgttgaattctcaaaacaaagggaagtctcgctcactgcctagagttctttcccccgagagcctgagttgcacggaaattcccattccattaaatgaaagacattcacctaaaatgccaccgtatcctcccacttgcgcaccaaatttggactccacgaggaattctgagaagagtggctgctcagccccatttccccggcctaagtttgggaggcccctcaagcccccatcttacagctcgcaccagcagtctaggggaggagcggacagcagtgactctcaggacagccagcagatggacgcctatgtccccaggcatgagctctgcctgtcagaccctggattggaacctccagtgtacgtgcctccgccctcatacagatcgcccccgcagaacatcccaaacccctacttggaagacacggtgcccataaatgtgtgtggcggtcacagtcaacagcagtctccgaccgagaaggctggggccagcggtcagcctccttcaggcccccctggaactgggaatgagtatggtgtgagcccccgcttgcctcaggggctccccgcacatccccgacctgtcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagagacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctccctcccttcctttcttccttccttctgtcctccctcccttgctacctcttgccctccttccttcaccctgtcctccttttcccttttattttttccccttctctttcattttattttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctactagggcttacaaccaagccaaaggaccatctcttctttcttccacctcccttcacccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagta

SEQ ID NO: 564 - DNA, 2115 bp, Human
agttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaaaaaaaaaaaaaaaaaaaa

SEQ ID NO: 565 - DNA, 1234 bp, Human
aaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattttgtgtgtaaaaaaaaaaaaaaaaaa

SEQ ID NO: 566 - DNA, 7265 bp, Human
gggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctccaggaggcatatatggcaacgaattggcaagaaatcaagataaagagaaaggtagagctgtatgtaaccacctggctagaacacagatgttaatttgatgctgtctgactactttctaggtctctggtctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggtaagggggcaggctttctggctggatgcgcctcccctggagctaccttttgctcatcacagcaggtactgtgtgtgtgtgtgtatgtgcatgtgtgttttcaggttttttactgtgataaaacacacaaaacgcaccaccttaaccatttccaggcgtggtcggtggtgttacattcacgctgttgcaggcgtgcaggtcggtggtgttacacacattcacactgttgcaggcgtgcaggtcggtggtgttacacacatttgggctgttgcaggcgtacaggtcagtggtgttacacacatgctgttgcaggagtacaggtcggtggtgttacacacattcatgctgttgcaggcgtgcaggttggtgctgttacacacatgctgttgcaggagtacaggtcggtggtgttacatgctgttgcaggcgtgcaggtcggtggtgttacattcacgctgttgcaggcgtgcaggtcggtgctgttacacacattcctgctgttgcaggagtacaggtcggtggtgttacacgtgctgttgcaggtgtgcaggtcggtggtggtacacacattcatgctgttgcaggagtataggtcggtggtgttacacacattcacgctgttgcagacgtgcaggtcggtgctgttacacacattcatgctgttgcaggagtacaggtcggtggtgttacatgctgttgcaggcgtgcaggtcggtggttacattcacactgttgcaggcgtgcaggttggtgttacacacattcacagttgcaggcgtgcaggtcagtggtgttacacactcacacttgcaggcgtgcaggtcggtggtgttacacacatgctgttgcaggcgtgcaggtcggtggtgttacacacattcactgttgcaggcgtgcaggtcggtggtgttacacattcacgctgttgcaggcgtgcaggtcggtggtgttacattcacgctgttgcagacgtgcaggtcagtgctgttacacacgctgttgcaggcgtgcaggttggtggtgttacattcacactgttgcaggcgtgcaggtcggtggtgttacacacattcattctgttgcaggcgtgcaggtcagtgttacacacattcacgctgttgcaggcgtgcaggtcggtggtgttacacacattcacgctgttgcagatgtgcaggtcggtgctgttacattcacgctgttgcaagcgtgcaggtcggtggtgttacattcacgctgttgctggcgtgcaggtcggtggtgttacacacattcacactgttgcagacatgcaggtcggtgctgttacacacattcatgctgttgcaggcgtgcaggtcggtggtgttacattcacacttgcaggcgtgcaggtcggtggtgttacacacattcatgctgttgcaggcgtgcaggtcggtggtgttacacacattcacactgttgcaggcgtgcaggtcggtggtgttacattcatgctgttgcaggcgtgcaggtcagtggtgttacacacattcacgctgttgcaggcatgcaggtcggtggtgttacacacattcacgcttttgcaggcgtgcaggtcggtggtcttacattcatactgttgcaggcgtgcaggtcggtggtgttacattcacactgttgcaggcgtgcaggttggtgttacacacattcacacttgcaggcgtgcaggtcggtggtgttacacacatgctgttgcaggcgtgcaggtcggtggtgttacattcacactgttgcaggcgtgcaggtcggtggtacacacattcacactgttgcaggcgtgcaggtcggtggtgttacacacattcatggtgttgcaggcgtgcaggtcggtgttacacacatgctgttgcaggcgtgcaggtcggtggtacattcatgctgttgtaggcgtgcaggtcggtggtgttacacattttcacgctgttgcagacgtgcaggtcagtggtgttacattcatgctgttgcaggcgtgcaggtcggtggtgttacattcacgctggtgcaggcatgcaggtcggtggtgttacacacaacgctgttgcaggcgtgcaggtcagtggtacacacattcacgctattgcaggcgtgcaggccggtggtgttacattcacgctgttgcaggcgtgcaggttggtgttacacacattcacacttgcaggcgtgcgggtcggtggtgttacacacattcatgctgttgcaggcgtgcaggtcggtgttacacacattcacacttgcaggcgtgcaggtcggtggtgttacacacattcacactgttgcaggcgtgcaggtccgtggtgttacacacatgctgttgcaggcgtgcaggtcggtggtgttacattcacactgttgcaggtgtgcaggttggtgttacacacattcacactgttgcaggcttgcggtcggtggtgttacacacattcacacttgcaggcgtgcaggtcagtggtgttacacacattcatgctgttgcaggcatgcaggtcggtagtgttacacattcatgctgttgcaggcgtgcaggtcggtggtgttgcacattcatgctgttgcaggcatgcaggtcggtggtgttacattcacgctgttgcaggagtacaggtcagtggtgttacacacattcatgctgttgtgcagctatcacttccatctccagagcccttttcatcttaaaactgaagctctcccatcacacagtgacccttcatgtccctccccagtccctgaaaaacactgttcaggtttttcttcctggacctcattgtgtggagttcctcgtgtgagtgcagtcacacacgatttgtcctttttttgttttcgtttgttgagacagagtctcattctgtcactcaggctggagtgcagtggcgtgatctcagctcactgcaacctccactcccaggttcaagtgattctcctgcctcagcctcccaagtagctgggattacaggcgcctgccaccacgcccagctaatttttgtgtttttattagagacagggtttcaccaagttggccagactggtctcaaactcctgacctcgtgatccacccgcctgggcctcccacagtgctgggatgacaggcgtgagctaccacacccggctgatttatccttttatttgggctcctttcactcagcgtctttaagcttcatacgcgaaagatgcttcagagattcctttttcaggctgaatatctgctgcgtggctaggccactttttgtttaatcctctctcctctggtggacaccaggactgtgctgttttggttgctgtaagcgcgggtgcacacgcctgcctgaggctgtgttttggccgttgtgagtgtgagtgcacacacctgcctgaggctctgctttgttgtgagtgcgggtgcacacacctgcctgaggctgtgttttgggtgttgtgagtgtgggtgcacacacctgcctgaggctgtgttttgggtgttgtgagtgtgggtgcacacacctgcctgaggctgtggcgcgatctcggctcactgcaacctccacctcccgggttcaagcgattctcctgcctcagcctcccgagtagctgggaccacacccaccaccacaccccgttatttttttgtatttttagtagagatggggttttgccatgttggccaggatggtctggaactgacctcaggtgatccacccactggcctcccaaagtgctgggattacaggtgtgagccactgtgcccggcctctttttactttgttaatggtgtattttgatagataacagattgtcattttcatgaagcacagctggttagtttattgttgctcatgtatttggcctcatgttcgagtccctgtttttaatcatgagctggacacagccctctttagagcaactgtgaccacttgtggtgagaagtgcagcccacaccatccacgtgaggctcccacacgccatccacgtgaggctcccatgcagacatttagaaggcgttttcactgcagctcagaaaatggccccaggcccccatgggcacccccatgtcaccagggcctctggttgctgccggtacacagggataggcagccaggcctcgaaggtgctgggcatgggtttgggtgtctgcgttgggtagagacccggagcgcccttgctgggcgtgccctaacatcccggtaccctgtgcccctctgtgggccaggacgcctggtgctgccagctgggcgtaagccctgaggagctgagggtggctgtgacttggaggatgagtaggagctcaccaggagggcgtggagccgaggcgtttaatatcatcaggagcaacactgggctcagaaggcaggcacacttgccgtccctccagagccatggctgacggccaggcctggtgggctctcgtgaggacagtgcctgtggttgtcagatgctgtcccttcgagtaagggatgagagccatcctgaagatgggtcagctctgtggtgaccacccgttgggagcagtgacattcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaaaaaa

SEQ ID NO: 567 - DNA, 3623 bp, Human
ttttcctcacactaaatcgaaaactctccctgttggtcctgatctgtttcagtcaggcaaattacatcctgggaaaacgtcagatgacaggggaggccactcgcttcctgctcatccagtttcgacactttctgtgctttcattagcttccagacctcagccctggccctcgctttactgtacagtcagaactggtttctacgcctcgcgagggtgggaggtcgtgtatgggaggaggaccgcttcccaccagcctcgttgggaagccaggagaaatctcttcaaatcctgcgattcagagtcaagtcccagtcgtcctttttctggtcggcccagaactgtttgtgcctcctccctcatgaggaatgatgtcagtggggccgcggtcgccgcccacgaagagtgtaaggctgcgaagtcggggctttcccgacgccccctccgtccgcgtctgcgtaggggaggtgacgagggcggggcgcggcggcggggtgacgtcacggccgcgcgcggcgtgggcggagcctcactttgaacccagttggcgggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 568 - DNA, 2825 bp, Human
cacacggccatggcggaggcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccaaaaaaaaaaaaaaaaaaaaaaaaaaaaaaaaaaaaaaaaaaaaaaaaaaaaaaaaaaaaaaa

SEQ ID NO: 569 - DNA, 3886 bp, Human
aaacgtcatcaggaatgcgcccatgagagcgctattagattggctggagggagggcggtgtcggcctacgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaattta

SEQ ID NO: 570 - DNA, 7546 bp, Human
tccatccctgaccgggccgaggctgctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggctgcgccagtaaaaaaaa

SEQ ID NO: 571 - DNA, 1716 bp, Human
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaaaaaaaaa

SEQ ID NO: 572 - DNA, 3188 bp, Human
ctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagctcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgc

SEQ ID NO: 573 - DNA, 1449 bp, Human
agaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 574 - DNA, 1762 bp, Human
gctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaataaaaaaaaaaaaaaaaaaaaaaaaaaaaaaaaaaaaaaaaaaa

SEQ ID NO: 575 - DNA, 2234 bp, Human
aactggctccgattggctgtggtacagcaggtgccgcgtccggattgatcaaagccaggtgggcggggctgtcgcccagggtgactctcccgggaggcgcgtgcccaggctcagtagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttcttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaaaaaaaaaaaaaaaaaaaaaaaaaaaaaaaaaaaaaaaaaaaaaaaaa

SEQ ID NO: 576 - DNA, 3484 bp, Human
gtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatcaaaa

SEQ ID NO: 577 - DNA, 2425 bp, Human
gctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaa

SEQ ID NO: 578 - DNA, 4441 bp, Human
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacagaaatcattaaatagcccaaatcatttagaccatagcaataaagtgaccggggttgtcatatatttagcaacatcttttctctttaacatgatgaagcccaaaagtgataacaaaagcatttgcttgaatttgtcacttctcaccaggagtactagaggtaaatttttaataacatactaatgtgaaatggtatctggtttttattcagactttttgtgagcatattcttatagacactagaaataaatacatagaaggagactttgagcacaagggagaagagagttattagcactcctgaggcctctggaatgctgcttttctatccaggtatcttgcttgctaccagcagaattgactggtattggttctcactggccagggagcctctgctctgttcctggaatataaggcttttattcaggagcaaatcattgatagtaactttgctttatctagccattgacttcagcaggctaaaactacattgtgtaactgactgttcaaaaaagaataagtaaattttttttaatctaattcccttatggaaagcaccttgctctatggcactttccagatcttttgggattttgtgcttaattatacatacatacaccaaaatcacaatagaaagatatgaagactttaattttagactctgaaagataactgggtgatcctttgtgttaaaattgtgatacaaacaaccattgataaataccaactatgaatccaaactctagagactttgaaaagcattgtttaattgcaggtaagaggaatcttctctttcctttaggcttatagtctctaaagtgaaaatttggcaggatatagtcatgcagctcataatgacattccaatcaaccacagactgcatatacagcagtggtcctataagattataataccatatttttagcatatcttttctatgcttagatacacaaataccattgtattacagttgcctttggtattcagtacagtaacatgctgtacaggtttgtagcctaggagcaatagtttatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatcataaaatgagcctcagttaatcacacacagtattcaggtgcctaggagtgcacaccggagaacagcctcatgctgtcaagctgcagaaacctttcatgcaaattcagatgaaaaggtctttacctcaagccagggtaacctgaatgaaggtgatagtttgtccagacacctgactttaccaagaagaattttgactttcatattttatgacaatcatataaaaattgacagtcctttgattattaagcttaatcttataatgctagaattttcaaatattttgttgactcttctccattgttaccgatcttgaaattcttttcttcgccttctgagaaggtattatttcttatcacaaagaatgatgaatatgattttatctacccttattttgggggtaatacgagaatatgaattgcatcatgatccccattatttctaacctaaaagtaaaattcgttttttttttcaaggcagagcagtcaattgattataagtatttatttcttttttcttcttggagcccagattaaaaagagttattttagatttaaaaatttcctgaaatagttgaaaaattatttttgaggagaaaattgtatccaagaaacccagaatgtaaggatacttgatttttatatccagataattctttcatgcactgaatggaagacagtatatctgtatattaatttttgtttagattttgaatcatttaacccttatccttttttcttgtaataagactatttaatgtttttctcttgtgttttccatctttatcaatgcattcgtgttggtcttgatgtatactacctgttcctagtgttatttttacacgtcatctcacagtaataatatcagcaattcttgctgcattgaacatattaaatacacatgtaaaatgaaaaagtaagcagtaggtaaaatcttgttactctgctttgcattctgcctaactcactgcatttgaaaatacatgtcaaattctttctgagggta

SEQ ID NO: 579 - DNA, 11650 bp, Human
atggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaagcttctgactatggactctttctttcggatgaagacccgaggaaagggatttggctggaagcgggcagaacactggattactacatgttgcggaatggggatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgacctaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggcacgggatgacatcctgaatggctctcaccctgtctccttcgagaaagcttgtgagtttggtggatttcaagcccagatacaatttggacctcatgtggaacataaacacaaacctggatttttagatctgaaggaattcctgcccaaagaatatatcaagcagagaggagctgaaaagaggatctttcaggagcataagaactgcggagagatgagtgagatagaagccaaggtcaagtacgtcaaactcgcacggtccctccgcacatatggcgtgtccttcttcctggtgaaggagaagatgaaaggcaagaacaagctggtgcctcgcctgctggggatcaccaaagactcggtgatgcgcgtggatgagaagaccaaggaagtgctgcaggagtggcccctcaccaccgtcaagcgctgggcagcctcacccaagagcttcacactggattttggggagtatcaggaaagctactattcagtacaaaccaccgagggagagcagatatcccagctgattgcaggctacattgacatcatcctgaaaaagaaacaaagtaaagatcgatttggactagaaggtgatgaggagtcaaccatgttagaagagtccgtttccccaaaaaagtccaccatcttgcagcagcagttcaaccggaccgggaaggcagagcacggctcagtggcgctgccggccgtgatgcgctcgggctccagcgggcctgagaccttcaacgttggcagcatgccctcgccacagcagcaggtcatggttgggcagatgcaccgaggccacatgccgccactgacctcagcccagcaggccctgatggggaccatcaacacaagcatgcacgccgtccagcaggcccaggatgatctcagtgagctcgactcgctgccacctctcggccaggatatggcatctagggtatgggttcagaacaaagtcgacgaatccaaacacgaaatccattctcaagttgatgctatcacggccggaacggcttcagttgttaacctcacagctggtgaccctgcagacactgactacacagctgtgggatgtgcgatcaccactatttcttccaacctgacggagatgtccaagggtgtgaagctattggccgccctcatggatgatgaggtgggcagcggggaggacttgctcagagctgccaggaccctcgctggggcggtgtcagacttgctgaaagctgtgcagcctacttctggagagcctcgacagacagttttgactgctgctggcagcatcggacaagccagtggggatcttctgagacagattggagagaatgagactgatgagcgattccaggatgttttaatgagtttggccaaagctgttgccaatgcagctgccatgttggtactaaaggcaaagaatgttgcccaagtggccgaagacactgtcctacagaacagggtaattgctgctgccacccagtgtgccctctccacctcccagcttgtggcatgtgccaaggttgtgagccccactattagctcccctgtgtgccaggagcagctgattgaagcagggaagctggtggaccgctcggtggagaactgtgtccgtgcctgccaggcggccactaccgatagtgagctcctgaagcaggtcagcgcagcggccagcgtggtcagccaggccctccatgatctcctgcagcatgtgcggcagtttgccagccgaggcgagcccatcggccgctacgaccaggctactgacaccatcatgtgtgtcaccgagagcatcttcagctccatgggtgacgctggtgaaatggtgcgccaggcgcgggttctggcccaagccacatcagacctcgtcaatgccatgaggtcagatgcagaagccgaaatcgacatggagaattcaaagaagctcctggcagcagcaaaactcttagctgactccactgctcgcatggtggaagctgcaaagggggctgcagccaacccagagaatgaggaccagcagcaaaggctgagagaagctgcagaaggcctccgggtagcaaccaacgcagctgcccagaatgctattaagaaaaaaattgtcaaccgactggaggttgcagccaagcaggccgcagcggcagccacacagaccatcgccgcctcccagaatgcagctgtttccaacaagaaccctgcggcccagcagcagctggtccagagttgcaaggcagtggctgatcacatccctcagctggtccagggagtgagggggagccaagctcaagctgaagacctgagtgcccagctggctctcatcatctccagccagaacttcctccagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcccatgaagcttgtggtccgatggaaatcgattcagctctgaatacggtgcagacgcttaagaatgaactgcaggatgccaagatggcagccgtggagagccagctgaagccacttccaggggaaacgctggaaaaatgtgctcaggacctgggaagcacatccaaggcggtgggctcctccatggcacagctgctgacctgtgctgctcaaggcaacgaacactacacaggggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctctgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgcaatgcctgccgcatcgcctcatccaagacggccaacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaacaaa

SEQ ID NO: 580 - DNA, 1146 bp, Human
ggcggagccgcctgggctgcagtcccacccgggagccggcagggagcggagctgcggagccgcctggtctcccgcgtccatcggtccattcctgcgtcgttctgtccttccgaacgcacacttcaggagcagccgcgaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaaaaaa

SEQ ID NO: 581 - DNA, 1407 bp, Human
gaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 582 - DNA, 3203 bp, Human
gcagccccgcgagcaggcagcgccggccccccgccccgcggccccgggccccggctccggcgccgtccctcctccccggccgggcgccgcggccccggcatgaggagcgggcgatgatccccgccaacgcctccgccaggaaggggcccgagggcaagtatccgctgcactacctcgtgtggcacaaccgccaccgcgagctggagaaggaggtccgcgcgggccaggtggacatcgagcagctggatccccgcggccggactcccctgcacctggccaccacgctggggcaccttgagtgtgcccgtgtgctcctggcgcacggcgcagacgtgggcagggagaatcgcagcggctggacagtgctccaggaggctgtgagtacccgggacctggagctggtgcagctggtgcttcggtaccgggactaccagcgggtggtgaagcggctggcgggcatccccgtgctcctggagaagctgcgcaaggcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacatttttttttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccggaaaaaaaaaaaaaaaaaaaaaaaaaaaaaaa

SEQ ID NO: 583 - DNA, 3433 bp, Human
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 584 - DNA, 2358 bp, Human
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 585 - DNA, 2947 bp, Human
cctgtttgtccgccactgtttgaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattaccacttttgtggtttattcgtggtccttgggatatttgagactgtccagaaatttatggttggaccttgaagcaagagtaggaaaaaactaataccagaaaagcataaatattaataacctcatatgaaagtacatgaatcatttagaaatatttatcactgtgatttgttgtaaaaatgaattgggtattttagaaaaactttattatacctctttgttatgatactgataaattgtgatcttgcagtcgatcact

SEQ ID NO: 586 - DNA, 1397 bp, Human
aggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 587 - DNA, 1516 bp, Human
gccctccccggagcccagagctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagacaaaaaaaaaaaaaaaa

SEQ ID NO: 588 - DNA, 3360 bp, Human
atctcgcgagaaagggttggcggggagggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaaaaaaaaaaaa

SEQ ID NO: 589 - DNA, 774 bp, Human
ggcctgagtgcgcctgcgcagtccgcgccactcagggagccggaggggacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaaaaaaaaaaaaaaaaa

SEQ ID NO: 590 - DNA, 1604 bp, Human
attcgaatcgaacgtccttacgggagccgggcgctggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagttgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaaaaaa

SEQ ID NO: 591 - DNA, 5643 bp, Human
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgttaaaaaaaaaaaaaaaaaaaaaa

SEQ ID NO: 592 - DNA, 3879 bp, Human
aattgttgagcgggccgtgctgccaggcaccgcacgttgtgtgtctgccctactctcgtggaaccaaggtccagtggagagaggaacataagcgaatgaagaaagaagcaatagagtctcagtgataagttcttggaaaaaaggtctttgccaatcctgattcccggaagagagtcggcagaattccttcctttaggcccctctggagccttggccgaccagccacttctgtggtctggggacagtcaccgagggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgaaaaaa

SEQ ID NO: 593 - DNA, 2050 bp, Human
gaaaacctgaatacggaactgaagcagcagctcagtttctcactccgaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtacccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgaaccttctttctgttcagtcctaaaattcgaaataaagtgagactatggttcacctgtaaaaaaaaaaaaaaaaaa

SEQ ID NO: 594 - DNA, 2339 bp, Human
acgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaaaaaaaaaaaaaaaaaaaa

SEQ ID NO: 595 - DNA, 1137 bp, Human
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaacacagtaaaaaaaaa

SEQ ID NO: 596 - DNA, 7391 bp, Human
atgacctcacggacaaagcgaaggcagaaagttaaaatcagcatatcgaaaataaatcactctagttaccgaaaagaacataggccgttttgggagcaccagccacctccacaccagaactgggctgtcgggggccgctgcggcgcaggggctcgtccgggactgagtcagcgccggggccgagaagttcggcgggaggcgcagggcggggcttcctcccgccgactccgagcccggctctacttttctgagtccacgtctcttcctttggacaggcgtggcagcccgggcccgctcggcccagcccctcacggactgcggcgcgcggctccccggggcccggcccgccgaacgcctcgctctacagccctcacctcgcggcgccgagcgcagcgtccgcggcatggagaccggctccgactcaggtcagaggcccgcccccgggccgcgggggactggccctgcgcgcgcggcggcgcggttaggccgggccgcccgcacaggccgccgcgtgtcgagtccgcgcggggagcgcacgcggggcgggcggcgacagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacg

SEQ ID NO: 597 - DNA, 3121 bp, Human
taggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccc

SEQ ID NO: 598 - DNA, 9445 bp, Human
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 599 - DNA, 1448 bp, Human
aaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcaaaaaaaaaaaa

SEQ ID NO: 600 - DNA, 2287 bp, Human
ttctcgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaaatttaccacagccttgtctgattttaagaatagattgtgtgaagatttagaatggaaagcaaccatttcttcccttcaccttcctcttcttacagttccccaggagtcatttttaaccacttttaatttctgttggtaacctctgtgtttaggtaatatgcttatacaactatttcttgatgtatcagttttagacaatgtatcttctgatttcaaaggtaatacaacatttaatgtgaaacatttagtgaatacagtaaaggagaaaataaaattgttagcattctacccagagataatatcaattcatattgtagtgtagatttttttaaagttcacatacacttttttgtaaaatgagaataatgtttatttcctgagatactgctgtattttttaattgctaatctgtattcttcaaatgaactgagaattccatttttccatcattttttccttttgattattttcgatctctagaaaaattggaaaataggagattaatcttatattttcaccatctagaattaaggacatacaatgtttgaatgtctttccctccagggttatttttaggaatggactaacacaatatctaattttaaccttgccttgtccgtatactaggaatattgatccatgtgtatacattcttgaaagatttactttaatggct

SEQ ID NO: 601 - DNA, 1894 bp, Human
cggcgtgccctggggcggcgcgggcgcaggggcgcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaagaacaaaaaaaaaaaaaaa

SEQ ID NO: 602 - DNA, 1501 bp, Human
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacacttctggtttcagatatttcttttctagccccttacccaagatttctagagctaatcctagtaacttttcttattaatgacttataatttggccccaaattggagctttttgccacctacctctggattctgatggatttcgccattatgggcatgtttaaagttagccctaaacacaggattttctacaagtggacagtcaaactccccacactaaagtggcagtcatcgtttacactcc

SEQ ID NO: 603 - DNA, 2442 bp, Human
gtgcgtcacagaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggattgacgttgctttaaaaaaaaaa

SEQ ID NO: 604 - DNA, 2100 bp, Human
cggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgttaaaaaaaaaaaaaaaaaaaaa

SEQ ID NO: 605 - DNA, 3721 bp, Human
aaaagggccggcgccctggtgctgccgcagtgcctcccgccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaa

SEQ ID NO: 606 - DNA, 11529 bp, Human
cgggggaccccacttgtgtgcagcctagacgctggttcagggagtcgtacatggaagccttgcggaaccccatgcccctgggcagctctgaggaggccctcggggacctggcctgcagctccctgactggagccagcagggacctggggactggggcagtagccagtgggacccaggaggaaacctctggcccccggggagacccccaacagaccccaagtctagagaaggagaggcacacacccagccggacaggtccaggagctgcagggcggactcttcccaggagatctcggtcctgggaaagggcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcagaacaacacatctcctataattcatagtatcttgctgttggtagataaagaatctgcatttaggcctgacaaggatgcaataattcagtgtgaggtcgtgagctccctgaaggccgtgcacaaatttgttgacagctgccagctgaccgcagacctcgacggctcctttccctacagccatggtgactggatctgcttccgtcagaggctggaacacttcgctgcaaactgtgaagaagccatcattttcctacagaattcattctgctccctgaacacccacagaaccccaagaacagcccaggaagtcgccgagttaattgaccagcatgagacgatgatgaagcttgtcctggaagacccactgcttgtgtctctcaggctggaggggggcaccgtcctggcgcggctgaggagagaagagcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccagcaatcctgccagaaaggactacagctggcgaaggagaacccgcaacgtacagaggaaatggtccaggatttcagaaggggcctgagcgccgtggtcagccaggctgagtgcagggagggagagctggccaggtggacccgctcgtccgagttgtgcgagacggtgagcagctggatggggcccctggacccggaggcttgtccctcctcacccgtggctgagtgtttgaggagctgtcaccaggaggctacctcggtggctgcagaggccttccccggggcaggtgtggcagtgctgaagcctcatgccctggggaaaccgtgggcatcacagcaagacctgtggctgcagtacccccagacccggctccgtctggaagaggccctttctgaggctgccccagaccccagcttaccgccccttgcccagagccccccaaagcatgagcgtgcccaggaggccatgaggaggcaccagaagccaccctcattccccagcacggacagtgggggtggtgcctgggaacctgcgcaaccactgtccggcctccctggacgagcgcttctgtgtggacaggacggggagaccctgcgcccagggctgtgtgctctgtgggacccactgtccctcctcaggggccttccaggggcaggggccaccacggcccacctggaggacagctctgcctgttcctctgagcccacccagaccctggccagccgccccaggaaacatccccagaagaaaatgataaagaaaacgcaaagtttcgagatacctcagcccgacagtggccccagggactcctgccagccagaccatactagtgtcttcagcaagggcctggaggtaaccagcactgtagccacagagaagaagctcccgctgtggcagcatgccaggagccccccggtcactcagagccggagtctgtcctccccctcggggctccaccctgctgaggaggatgggaggcagcaggtgggcagcagccgactgaggcacatcatggccgagatgatcgccacagagagggagtacattcggtgcttaggatacgtcattgacaactattttccagaaatggaaagaatggacttgccccagggccttcgagggaagcaccacgttattttcggcaacttggagaagctccacgacttccaccagcagcacttcctccgggagctggagcgctgccagcactgccccttggccgtgggccgcagtttcctgagacacgaagagcagtttgggatgtacgtgatctacagcaaaaacaagccgcagtcggatgccctgctcagcagccatggcaacgccttcttcaaggacaagcagcgggagctaggtgacaaaatggacctggcctcctacctgctgcggcccgtgcagcgtgtggccaagtacgcgctgctactccaggacctgctcaaggaggccagctgtggcctggcccaggggcaggagctgggcgagctccgagccgccgaggtcgtggtctgcttccagctgcgtcacggcaatgacctgctggccatggacgccatccgcggctgtgacgtgaatttgaaggaacaggggcagctgagatgccgggatgagtttatcgtttgctgcgggaggaagaagtatctgaggcatgtgttcctctttgaagacctcatcctgtttagcaagacccagaaggtggagggcagccacgacgtctacctgtacaagcagtccttcaagacggccgagatcgggatgacagagaacgtcggggacagtggcttgaggtttgagatttggtttcgcaggcggcggaaatctcaggacacctacattctccaagcaagctcggcagaggtcaagagtgcatggaccgatgtcatagggaggatcctgtggcggcaggcactaaagagcagagaactcagaatccaagaaatggcatccatgggtataggcaaccagccattcatggatgtcaagcccagagaccggacccctgactgtgcagtgataagcgaccgggctcccaaatgtgcagtgatgagcgaccgagtccccgacagcatcgtcaagggcacagagtcacaaatgagagggtccacagcggtgtcctcctctgaccacgccgcccccttcaagcgaccacactccaccatctcagacagcagcacctcctcttctagcagccagtcctcctccatcctggggtcgctgggcctgcttgtgtcctccagcccagcccacccgggcctatggagccctgcccacagcccctggtcatctgatatcagagcctgcgtcgaggaagatgagccagagccagaactagagacgggcacccaggctgcagtgtgtgagggggctcctgctgtgctgctgagccgcacacgccaggcctgatgactgtcagggtggcagtgcccatcatgtggctagaacaatacagagggagcagcacgccaggcctgatgactctgggggtggcggtgcccatcgcgtggctggaacgatccagagggaatagcacagcaggtgtccaggtatttcccaggattttagacattccctaacattttcaaacaaatttataattttgtcttatttaaaaaacaaaccttccacttccacccaagacaacagcataggaaacagacctaaaacaagacaaaaaaagactaaacatgaaacaaaagatgtcaagacacaagacatttggcaacaaaggaccgcgatccctgagagacaggaaaacgggaggtgagcccggtgatggcctcagacctccctccgccttgagagtttgcaggcctcagtgcagggaggggcccaggaagagcccagcagcctccgtgagttgaagagaccaagtcagcaggagttggcaggtcagagtgccagagagagatgcctgcatggggaaagactcaccagatcagcccctccagcacctagtgggttgctacccattcgcacactcaaacagggaggctaccaaggctgggagcaacctttgaaaagaccaaagatcaattcctggtactcatgtgggctggggacaggacccgttcccaccagccagactagggaaactctcaatagatcaattcctgatactcatgtgggctggggacaggacccactcccaccagccagactaggaaaactcccaatctgtgagcattaggtggagttctcagaaaatcttgcctcaggaatggggataattagccctagactgagccctgctcctgactcgcctacaaaatcataaaagcaagacctaaaatgatcaaaccattcccagataattcactttatcccagaacaaagctccagatgatctaggggttaccaaagtgtccacaccctgcaaggtaaactcacagtgcctgacctcggagtgccaggcgtgcagaggagcagccaagggcaaacactccaaggagagtcgcctggcaaagccaaccacccagagccagcgtctgtgctagaatcacagaattcaaactgtggctgaaatcgcagcccaggcgtccagaaagttaaagttaagaacctataatcccagcactttgggaggccgaggcaggcggatcacgaggtcaggagatcaagaccatcctggctaacatggtgaaaccccgcctactaaaaatacaaaaaattagccgggcatggtgttggccgcctgtagtcccagctacttgggaggctgaggcaggagaatggcatgaacccgggaggcggagtttgcagtgagctgagatcacgccactgcactccagcctgggcgacagagcaagactctgtctcacaaaaaaggttaagaaatgacttaatggaagagattcagaagacccagaccgaccttacagggatgagaaactacaatattgacagtggaaactatcctggatggggtaacagattggatttcacagaagagaccatgaggcaccttgaagacacatcagtggaaactatttgcatttgttgggcctccagagagacagaaccaataggagatagctagatatatatacagacagatagatagatagatagatcgatagatagatagatagatagatagatagatagatagactgacagacagatgagaggggccttaggggcattggctgacacaattttggcaggtcaagagccccacaataggccatccacaagctggagacccaaggaagctgctagtgtgcccagtccgagtcctaaagcctcagagccagggaagccagtggtgtaattctcagaggccaaaggcctgagaacctgggggccactggtataagtctgagtccatagacccagtgaactccaaacacaagagatacgagtgcacatcataatcaaattgcatataaccagtgataaacagaaaatcctaaaaccagtcagaggacaagggcatgttctgttgggaggcacaaagctgatgaggatggctgactcctcaggagcagcatgggtgagaggcagtggaatgtactaaggagaaaactgccaaattcacattctgtacctgacaaaatctttccgaagcgatggtgacataaagacattttcatacacacagaaactaagagtttcatccccagcagacctgcactacaagaaatgttaaatgatgtgcttcagggaaaagaaaaatgaagagcatgtgcaccatccaggattttcctcgttatttaaatccctttagcccatctcccatttgccccaaggaatgagtgctggcagtgagctgcactttttttttctctaaacgggaaatgggttaaaagatgagtggcttggccgggtgcggtggctcatgtctctaatcccagcactttgggaggctgaggccagaggatcacttgacttgagcccaggaactggggggtcatgctgggaaacatggcaagaccgcatctctattaaaaataaataaaagttaactgactgtttaaacaaaagtattaacgtatctgcggtttgtactatacgcacaggtaaactgtgtgaccacagcagcgtgatggctgggagacgctggatgtgatacgtgaagtgaggggtatcacttgaaggtagattgtggtaagctaaagatgtactgataaacccttgaaacacccactaacaaagaattacagctaatagaccaacagaggagataaaatggaatttttaaaaatccagtccaaaaatacgtagagaaagagggaaagggaagaatggacttgggggcgacacagaagacaagtggagagagactgaagcagccactggccatcacagcaaacacaagcagggcgcaggacgccggcaagccacagacaggcctgctctctgaattggtgaccacatgagtaacttcacgggtctgttctatgtccagagttgtcaaactgcatgctttaaagatgtgcagtggatcgtatgtcgcttaaatcccaacaaagcagtatttttttaaagtacaatcatgcacacagcacttcccctgggaggcaggggctgtgcccacagaagtcgttacctctgcgtcctgagtatggacagccaccatcacacagccccagaggccgcccaggctctagccacactctggcactgcctgggacaggtgccctcaggaacccaaatgccactgcccccgtgaaagccacttcaagcgtgttgcttcaaatcagaaggcatctacgcctgtggaagaggaggctgctgggggcccaggtgtgcagggggcagggccaggtgcaggggcacagcttatgcctgtggccaacccactggggagcaaggctggggatatgcccaggccagcagggccagcaggagtgactgcgccatcctgaacacgtccttgggcctcccaggaccttggtgcctcccatctgggctggcacaagcctccagtcaaaagatgggtctctctctcctgatagcatggagcctggatgtgggaatggagccacaccagccccacgggagccccacgacccatcgggctgtgggatgcatccccacggccgggacccctcagcctgtgacttggtctgggcagatgcaaaggccaccctgcagggctgaggtgtctgtggggaaggaggtgcccagccctgggaggccatcttgctcctgctttttatttaacccatggggctctttggcctcattttctgttttttgagtttctcgtgcactccaaactgtcctggagccagccctggtgtgaaacagaggcttcctgctggcagaagaggcccaccgagttacgtccacaccagctggccctgggcacctctctctctggccttctgtccacactgggatttggctctgatttccagaaggcagggttaggaaacacctgtttccaggcagagtaatgcttctgtctgaatcaggcctcatgggcttcaccagcagacacgaaggtttcatttagatggcgaacacgtgttctcatttctccagggttctggacccgtgagctgaagcaggtgctgagaagtgggagaggcggccactgggtccctcagggtcactcaccccgccacgtgaggccacttccgcccagcactgggggcgctgggagctgaggggcccacaggggacgtgggagacagccccgatgcgtccccatccgcagtgacgctagcgcggagtcgtcgccaagcacgtggagggacagccctggagccctggcctggcccagcatctcccagagtcacttcctgatgcctccccagccctgcccaggaagggtttgtggccacagccccacagcggccccctcgcctcgaccaccagtgcctccttccaagctgcctgagcaatcctgggtggtgagctccaccactcccacccacgcctcagcactgggaccccccagggatggtgtggggattcctgccccccgtccatgcctcagcactgggagctgggaaggtgtgtgatttcctcccccacctcagtactgggacccccaggaagggtgtgtggccccaccatcctgaatgctcagggctggtggtcagcgaggtggtttctaaaccaagccctgggaggagccatcctgggactgtgcttggacaaggttggggctcccgcagtgagctctagccctccccaggaccctcccacggccccagggtgccggccttcagattgaccccattcgtggatgagtctacaaggctccccagtgcccagcaagagtgtttttacattcagaggtgaggaaggggtgccggcatctgccccagacacaaccgggcaggtacagatgtcatccccttgaggacagcagggaggcgactcaggagaggctgatcagacgggagccgcatccccatcaccttccagagagacctcttcttttgccaggtgtcgtgagggctgtggcttagctgggcctgcgtccatccccggttctggggagatgcccgggcccctcctggatggcagcagcagtggaggtttgggttttgagggagccctaagaacctgagagacttagatggagcatggcacgccctggagagtccacgtccccagacccctcatgccaacaccattccacccagcagtttcttccctgtggtcagaacaaaacccccaagcctcaggcctcaggctggttttctgacaggcaaaatgctccttacataaggaaagacctttccttggctgaccctaaagtagccaaggggagctcacatcgcctggcctgccgccaccaccaggctgcctgaccagctcaccgccttgttctagatgcttctgaagcaacagctcgcctggccccacccccatcaagcatctgctgggcagcctccctccccggcccgcctgtagctcccaaaggtctcaagcctcaacatcctggtaaccaagtgcacccagagggctggcagggtcacatggaggcaggggacccttggccccagggtggtcgtcttcccaggaggtccgcctgtcaggtcagagggcagcaggaggccaccccacctccccgggttccctcgagcattcctttgtcaggagcagctcccccaggatccaggcatccctggcccccctttgcccccgccctgctctcaggagccccctgccaggtgctctgaccacaggaaacaggagccctcagggccactgccagaggacggattctgctgccaaccagaggtcctggggctggcggcgctggtgtgcctgccctgggccttcagcagcccccataaggagaaagctccagcctcccgttcagagaaggctccatcctggggacacgcctctcccaaggtcacccacgtgggggctttgttactcatgcttcccagactgcgtgctgtgtcagagttttcacacctgcctgatgtcctgggggggctcacagaggaccgaccctgcagggagatgctgacccaccctgagacccaggagaagaaaacggccagggtccaggctgctcccaccatccctgggggattagcaccttggctgagcccgaactgaccacctggggcgtaggtccaagatttaattacaaaacgataggtgaatgtgggttctgtgtgcctgtgacatagagaatgttttccacaccgcgtgtgaaatgacgagagcttttgtgtcacacatgtagctgctacgagacagacgctcttgttccggatcagagcagcagacagaaccggcacttttagggtccaaaccctgttgcccacagaacgcccatgacaccagctgggtggagctgccgccgagtccacgccccgtctggctgggacctggagctcccctcaagctgcagatccactctgcaccacaaggtggcctcgcagaggagcctcccgagctttggaaccagaggcaggctcagcgatgctctccatccggcctggccccaccgtgtgtatcaggtgtcagaggccttgctgggtgccaggccacgtctgtgctgtcacagctttgaggggccagcgggtcctagggagaggcccgtgcgacgtgagtaacagcagtttttcttctgacagctgggatggaggtgggtcctccagggagtgccccagtcctcgagagccagacttgtgcacgggcctggaaatgaaggtctcaggcaggggctgcgcacaccgatggtcagcattgccgttcggggcctgcagtcgcccataatgggccctgccccctaggcctggcctcttttgctttcctcctggatggttcctctacccctggtccagcagggactcagcagtgcctgccagctgcagacccccatgctcctgcagcctggaaccctcctgccctccaaaggtcatggggtgacccagggtgggaacaccagaccccctcaccccgtgtccaccgcccatggccgggctcacagtgtctcagagccgtggtgagccatcctaggaccagtgtacctcacaacctttcagaccagtgaaggccagtgggctgggtggtccaggcatgtccccaacgcaggtccagccatctctgcacagaactggaatctcggttcatttcggtttcagcaggtcccatgtagttagcaggacagcacttgagttaggtctgagaaagaacgcctgtttgtcatggcatttcctgtaaggagcccagagccgtggccccaggttgggacggcggcgccagagctgggcctgagtctgacccaacctgtgctgagtggtcctgctggaatgggaaccccaagaggaccacccctctctaaaagaagggaaaacagtaagcgagagggaggctgcaggggcccagaccttggctgaccttcctagccatggtctccaccctccgagacccaggggccccgcagtgacagcagggtgttgggccacacagagcccgagtaggtaaaggaaggttctggaaaccacttttcagaacccaaaaggtgtctgggaaatggcgttacctgccactgttgttaagtgtttactttgtatcaatactgaattgttaaaaattttaatcataaaaaccaatggaacatgtttttcaaaaaaaaaaaaaa

SEQ ID NO: 607 - DNA, 2423 bp, Human
ttccgcctccagcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttgaaaa

SEQ ID NO: 608 - DNA, 2793 bp, Human
atggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctggtttttcatttatttggccaaaatgttatattaatggagttattgctatttttgctgtgataatggtattatgcaagaccatattctcaattatttggatatgcaaactaaagtattaagagctaatgtcattatatatgtaacttaaatctagacaccatcaaagcataaaataaaaataaaaagcgttgctgaaaaaaaaaaaa

SEQ ID NO: 609 - DNA, 3060 bp, Human
gccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacaaaaaaa

SEQ ID NO: 610 - DNA, 2200 bp, Human
gcatcctctcaccgccggaagctgaactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtaatgcatgtccatggtacacaaattcacaagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtaaaaaaaaaaaaaaaaaaaa

SEQ ID NO: 611 - DNA, 4128 bp, Human
gtttccggggcgcgccgcggaacccggaagtggtcacggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttaaaaaaaaaaaaaaaaaaaaaaaaaaa

SEQ ID NO: 612 - DNA, 1471 bp, Human
ccgccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaattttccttgagaaataaaaaaaaaaa

SEQ ID NO: 613 - DNA, 1281 bp, Human
gatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaaaaaaa

SEQ ID NO: 614 - DNA, 6018 bp, Human
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 615 - DNA, 1352 bp, Human
ggcccacgtggttccgacagtcaagatggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaacttacaaaaaaaaaaaaaaaaaaa

SEQ ID NO: 616 - DNA, 704 bp, Human
ggtttataggtcccggcccgagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatgaaaaaaaaaaaaaaaaaaaaaaaaaaaaaaaaaaaaaaaaaaaaaaaaaa

SEQ ID NO: 617 - DNA, 1593 bp, Human
agctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttgttgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaa

SEQ ID NO: 618 - DNA, 2327 bp, Human
gcgcggggcggggcttccgggcggggcaggctggcttccggcgggagcggggccgcggatggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcgaaaaaaaaaaaaa

SEQ ID NO: 619 - DNA, 2405 bp, Human
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaaaaaaaaaaaaaaaaa

SEQ ID NO: 620 - DNA, 4725 bp, Human
caattcggcctcgctccttgtgattgcgctaaaccttccgtcctcagctgagaacgctccaccacctccccggatcgctcatctcttggctgccctcccactgttcctgatgttattttactccccgtatcccctactcgttcttcacaattctgtaggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatcttcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccagcaccccactccaaagtctggactctttccacatcctgctccagacagccaagctttgttggggtccccactgctttgagatgggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtc

SEQ ID NO: 621 - DNA, 3207 bp, Human
gggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaaaaaaaaaaa

SEQ ID NO: 622 - DNA, 1692 bp, Human
tagacttgtcggcgctcgattgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagacccaggcaggatctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgaaaaaaaaaaa

SEQ ID NO: 623 - DNA, 2058 bp, Human
gagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 624 - DNA, 2746 bp, Human
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtaccccacatcctctcctccgggacagtcaccgaaaacacaggttccaaagtctacctggtgcctgagagcccagggcccttcctccgttttaagggggaagcaacatttggaggggatggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaaaaaaaaaaaaaaa

SEQ ID NO: 625 - DNA, 1542 bp, Human
gctctcggccaatgcggagccccgcgcggaggtcacgtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaaaaaaaaaaaaaaaaaa

SEQ ID NO: 626 - DNA, 1352 bp, Human
gaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaaaaaaaaaaaaaaaaaaaaaaaaaaaaaaaaaaaaaaaa

SEQ ID NO: 627 - DNA, 3122 bp, Human
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 628 - DNA, 1294 bp, Human
tgggctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaa

SEQ ID NO: 629 - DNA, 2356 bp, Human
cagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaacaatttaatactttaaaaaaaaaaaaaaaa

SEQ ID NO: 630 - DNA, 3685 bp, Human
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctcaaaaaaaaaaaaaaaaaaaaaaa

SEQ ID NO: 631 - DNA, 1940 bp, Human
ggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtttaaaaaaaaaaaaaaaa

SEQ ID NO: 632 - DNA, 3998 bp, Human
gctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacatactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaaaaaaaaaaaaaaaaaa

SEQ ID NO: 633 - DNA, 4575 bp, Human
agcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaaaaaaaaaaaaaaaa

SEQ ID NO: 634 - DNA, 4968 bp, Human
gcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 635 - DNA, 1137 bp, Human
ggaagcggcggcgggagcttccgggagggcggctcgcaggcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcagctccatcttgtctacaagattttgttagaagccgtcaaaatcctgctgactcgagatgcgctgtggtgcatgttttccccgggcacagcaggctaataatcctgttacaaagagaaatgctgtacatttcgagcagtgctggcccctgggactcaccgtggccttttctaagtgcttacagactctctgtttaataatccattccagaaattttccagggctcattgttgagcttggtgttcgcaactttgagtgatcagcccttctcctttgtgggagcaccaggacagagcagcctttgtccctccccagtctcagttccctcccactgcccctgtggacctcgaatgcagagcttatgcacctaccgaaggtcgtgtcagcacccaaggcagaacgaggctgccctgggaactagggtcaattaagacagcttgtgctggaggaccctttacagcagatgaaggcctctccccagccagaaaagatggagcacacgctgggtggtggccccgcttcctcactggaaggagatggtgctcttcttttttctttctgaattgtggccaccttcataccagtctgtcatggaacacttaagtcgcttgagtgcctgctggtactcccagccctgccatgcctgagccccctgcacacaaggagccaggagtaatcagggcagaccctttagggcacggggacttctggattgtgaaattggctctctgggggccaaggccttctaacgttggtggaagtggctttggcttattgggtcggattctaggccattcattccaacctttagagacatcccagctttccctagcccagagtctgcagcccctccaccatcccacatcctccccctccctttcctcatgaaccccagtcgcgcctctgccttctcaaacccctccaccatcccacaccctcctcctgcc

SEQ ID NO: 636 - DNA, 5396 bp, Human
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 637 - DNA, 7333 bp, Human
agaaatccagcccttctgccctccggaggcgcctttcccaacgtaaagtacaattttaaatttcagctcctgactaaaatcatgatccgcagtcaactgctagagaatctgggcaccccggtgtctctggagcgtgcagcgagtgtgggcaagggcagggggagtgggcgaagctgctggttggtgcctgaaatctgtgcgttgcccctttaattgtgtccccagccctcgggcgtttctgtccaacgcccacgtcagcaaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctggtgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgttaaaaaaaaaaaaaagtagaggctggccaaagattatatacagatattttcttaaagcaggaaactaatgttgcctaaaagtcaaggtagtttgtgaagacaatctgtcaatatggttgtccatctctctaaagaaaagcaggctgggcgctgtggctcatgcctataatcccaatactttgggaggccgaggcaggcggatcacaaggtcaggagtttgaaaccagcctggccaacatggtgaaacctcgtctctactaaaaaatacaaaattagccgggcatggtggcgggtgcctataatcccagctactcgggaggctgaggcaggagaatcgattgaacctggaaggcagaagttgcagtgagccgagatcacaccattgcactccagcctgggcaacaagagcgaaactccgtctcaaaaaaaaaaggaaaacaaactaggaggttcttaccatatgtgagtgatttctaacgtttatgtagtgctatattatttataaagtactctctcatgtattttctcagtgaggtggatactatctccgatttacaaatgaggaaattaaggtcagaaagtctgagagagaaaactgatgattggacaggatctgattttaaacaatcctctttcagccttctctccctgtatgtctcctgaaatggcaaagaatagaagtcaaacctcaccagttggcagtcattataaaaataagccaatcagaattagaaagtatgaaaggaggaattgaatcattttcaacaacatacaatatcttgatctagagattttcaaataatgctaagtaatgtccctacagtacctattggtatgtttttatgtcacgttatttatatgtaaatttaaagtataaaactatttgaacaaattattcacttaaatatgttgaacatttttgcttctcttgtttatataatattttcaaaacaaacttttctcctagtatacaaagtttaaacttctcccctttgggctgggcccagtggctcacgcctgtaatcccagcactttgggaggctgaggcaggtggatcaccgaggtcgggagtttgagaccagcctgaccaacatggagaaaccccgtctctactaaaaatacaaaattagccgggcgtggtggtgcatgcctgtaatcccagctactcagaaggctgaggcaggaggatagcttgaacccaggaggcagaggctgcggtgggctgaggttgcgccattgcactccagcctgggcaacaagagcgaaactccgtctcaaaaaaaaaaaaaaaaaaaacttctcccctgcataaattatgaaacattccaaaattacagctaaattagagaagcattgtttcagttctaaaggtaaaatctaaatatccgaagtaaagaactgagcttcataaaggtctcttctgcaagttatcacagtgaagcttgatagaatttcactgtatatggagaggctccatctattttactgttttcttttttgtttttgtttttttttcgagacggagtctcgctctgtcgcccaggctggagtgcagtggtgcaatctcagctcactgcaagctccacctcccgggttctcgccattctcctgcctcagcctcccgagtagctgggacttacaggcgcccaccaccactcccagctaattttttgtatttttaatagagatggggtttcaccgtgttagccaggatggtctcaatctcctgatctcgtgatccgcccccctcggcctcccaaagtgctgggattacaggcgtgagccactgcgcccagccaattttactgtatttttaaatgccatgacatacctcaaaattatcctttttatgttactattttctcttgttctttcattaattattgtccttgataccaatttctaggctaaattggttactttcttttaaaaaatttaaaaatagatgaataaccacttgtttcatggtacttaattgagactttttcaagattcccctgatggcacatttgcagttgcttcaagactggatgatgtgcattgagttctctgttctcccaacatggctgttcctaaatcaggattctggtttttttgagatggactctcgctctgttgtccaagctggagtgcagtggcgtgatctcgctcaccacaacctctgcctcccgggttcaagcgattctcctgcctcagcctcctgagtagccgggactacaggcatgtgccaccatgcctggctaatttttgtatttttagtagagacagggtttcgctatgttggccaggctggtctcgaactcctgacctcgtgatctgcccgcctcagcctcccaaagtgctgggattacaggcgtgagccagcacgcccggcctaaatcaggattcttaacaattaaagtgtatctgaatgaggaaggaaacgcttgtcattctctagtcttacccaattaatactgacaccttttgaaattaaaacctgattttttagttgttggagccagtaggaaaaatggctgatttgaacttttttcctataaatgaagtagtgcttgcatgtgtgtactctaatgcactttagtctatgatctaaatgtccttttatgctattatcttctgcatgcaaactttacatacatcagcatgaatatccaacattcactgaacacagtgccaccagcacttgtaattgccttttcagaaataatgctttctcataattgtttataacgagcatcaaactatccccacaaaatgatcaagttcaccaaactagacaaagaatctgttgtatcattttaacatcatagaagaacatttaagacatgtttgtaagttgtaaataatgactccagttatagcatatatatctaagacgttagagaccagttattttctagagtgaaactgtctattgatgattgagaaaattgaattctttggtttttacatgtgggcaaatgttacataggggtataatctgtttaaataagctttatttatgccaaggattttttttttaatatcaagacttggttagaccaaagtttgctcttgcaggaatgccatttatcagcttctgaatgcccttctaactccattaccctcaagagtgtctgggtataggatgaagcattacaaaaagaaagcaccactgcagtcatgcctagtgtctgggagaaacaaaatggactagacctgcagtttaaaataatttaacccgagaaactcttcaaatgaattgtttcctaaagatgctcaaatttaagggataaactctaaaatcagagctgctgtggttaaagtcccccacaaacctttccccagacacctctgcagaactcaggtgcacaatgttgaaaaccatggaattagacaacttcctgaattccctttgagccttgcagcctcatttcgttactcctgttactcacggtgcttataagcaggtaaccatatggtctcttagtgaagcaaatcacatccttagcacatgatgttccttctatgggtatcagatcttaagactttttaaaatttaggaacaaatgtttcaatattatattttcagtaatgcaatcaaaataagcatagttactgttttctgtacggctaagtactgcctaatggatgaaagaagtttggtgcttcaattatttatgagctcagaactcaattcattaaagttattttgccaagtcatgccaagatatattgaaatttccactcatattggtttttaaaattttttttagtcctaaaattaataagtatggaaaatcactaaaagcagtgtaggataaggtgtgtttaactggccgggcacggtggctcatgcctgtaatcctagcactttgggaggccgaggcgggcggatcacttaaggccaggtgttcgagaccatcctggccaacatggtgaaaccccgtctctagtaaaaatacaaaaaatagctgggcatgatggtgggtgcctgtaatcccaggtactcgggaggctgaggcaggagaatcgcttgaacccgggaggtggaggttgcagtggccgagatcgcaccactgcactccagcctgggtgacagagcgagactccatcaaaaaaaaaaaaaaaaaaaaaaaagatgtgtttaactgggaagggtgataataatagaataataggtacaggaggaccaaactttagattataaaccagaaagttttgttattttatataagtgtatcagtattactatttatcatttatatagcattttatatttgcaaagtgtttaataatttttgttattctttacatatatatgaaataggacagttatcccacatgaacggtaaataaattgaggcacagaacagtaaaaaaacctcagggtcaggcgtggtggctcacacctgtaatcccagcactttgggaggccaaggcgggtggatcactttaggtcaagagttggagaccagcctggggcaatatagtgaaaccccttctctactaaaaatacaaaaattagccaggcatggtggtgggcacctgtaatcccagctactctgggggctgagacaggagaattgcttgaactcaggaggcggaggttgcagtgagccaagatcacgctactgcactccaggctgggtgacagagcgagactccacctcaaaaaaaaaaaaaaaaaaaaaaaaaagaacctaagacaacccagtgaaatggtagcaaaaaataggaaatataatgatcacattttctgaatcctagaccatcagcctaattcactgaggtgtgttgtgtatcactctattttatagatgattttatataagtaacagtggattgttttaaagctgacgtcattgtatgtggatacattctatatggaataaatgttatgtaaagga

SEQ ID NO: 638 - DNA, 2080 bp, Human
agttgtagttcggggtgaggccggggcttcatggggagttgttgggctgaacgagcggctcggagtatgggattgggggagggggacgggggagtttggcgcaaagcctgctggggcatggagtcccggcgagctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaaaaaaaaaaaa

SEQ ID NO: 639 - DNA, 5069 bp, Human
ttcctgtctgccctccgcgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaaggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcagaaaaaa

SEQ ID NO: 640 - DNA, 4097 bp, Human
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaaaaaaaaaaaaaaaaa

SEQ ID NO: 641 - DNA, 1685 bp, Human
atgcgcgtccacgcctccctataagataaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactgaaaaaaaaaa

SEQ ID NO: 642 - DNA, 3159 bp, Human
agtgacagagcgattactaagcctacggttcccaaacgactcaggtgaacctgatttacaggaaaggcgggctgtagctagggatggagacagtacctatcagcaagcggctccacagctcggttctctatctattctgaagacatgcggggccactcactgctcctgatagtcctctacctcccacagaccccacccactacgacacggaaaactggattacccaaatacctgcctctgagtctggggacgcaggcaagcacaaagacaagggggatggagcttctacacagggccccagcgctgtcgctgtggctgctgctgccgctacggcttagtgcaccagacgctgcatttcaggtgctcctacaaaagaggccactcctggaacgccgggagctcagacgctgccctttgctcgcgagccaagtcagccaaggttaaccttcgcggaacccggcgaggagcgcaagcctggccttccccaaacacagatccgagcttttcaccctctaccctcccctcagcctggccttttcttccgccctcacagccaccgcgacccaacgctgaggaaagaccccgacttgtggtgtccttccccttgcccaaactggccacgaaaggacatatagcgagagagaaagaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatcttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaaaaaaa

SEQ ID NO: 643 - DNA, 2646 bp, Human
ggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtgggcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcagggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaaaaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaaaaaaaagacatttcatctaagccacttaaaaaaaaaaaaaaaaaaaa

SEQ ID NO: 644 - DNA, 1223 bp, Human
gggatccttgagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaaaaaaaaaaaaaaaaaaaaaaaaaaaaaaaaaaaaaaaaaaa

SEQ ID NO: 645 - DNA, 2614 bp, Human
ctccctgtttctgtcttgaacctgattctttcttcttatctccttcctgtgtccacctcaagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttttctgatgcaaaaaaaaaaaaaaaaaa

SEQ ID NO: 646 - DNA, 3522 bp, Human
ctcaccccggccgtccggccgcttcattgtcaccgggcctcggggcagtgttgggggtggcggggcgccaggtcgccgacccgaggtttgggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccactgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacaccaggcggcactgcccaccaggccctcaaggccaacaatactggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgtgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgcaaaaaaaaaaa

SEQ ID NO: 647 - DNA, 3682 bp, Human
ggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaacaaaaaaaaaaaaa

SEQ ID NO: 648 - DNA, 2174 bp, Human
ttccctgagacttccctcctccctcccctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataaaaaaaaaaaaaaaa

SEQ ID NO: 649 - DNA, 4907 bp, Human
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgaaaaaaaaaaaaaa

SEQ ID NO: 650 - DNA, 1573 bp, Human
ttttgcctagcgactgacaacaggctggttgcttggcgtggaatcctaaagtggcctggctttgagactggagtgagaccccagccctaggctggggttctttccattatagaggagacggattcaggagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatggtgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggagagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctctattatattg

SEQ ID NO: 651 - DNA, 1671 bp, Human
aggaagtgcgcgcggccccgcccccgccggttcgcgtctctctgctgcggcgcggggaccgctgtgctctcggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggtgcggtgtgcaccgagcgcgcctggcctgatgccctggcctgtgagctggggactcctgggccctgtgagcccctaggcggcaggcccaggaacggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcacctgcagcttccactctttatttccaaagaatcagtgtcacacatgcagatcac

SEQ ID NO: 652 - DNA, 1596 bp, Human
tgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaa

SEQ ID NO: 653 - DNA, 1664 bp, Human
ggtggcgcggccgggcccagctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcatacaaaaaaaaaaaaaaaaa

SEQ ID NO: 654 - DNA, 5473 bp, Human
ggaggtgcgagcccctgccgggtcccccctgcgccggaccatgtattcggcccacaggcccctgatgcccgcgtccagcgcggcctcccgtggcctcggcatgttcgtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacac

SEQ ID NO: 655 - DNA, 3036 bp, Human
gggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatga

SEQ ID NO: 656 - DNA, 6733 bp, Human
attgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaaaaaaaaaaaa

SEQ ID NO: 657 - DNA, 2471 bp, Human
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcagggaaaaaaaaaaaaaaaaaaaa

SEQ ID NO: 658 - DNA, 4090 bp, Human
tcactccgccccttctcgtgcacgcgcccggagcccgcaactctcgcgagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcaaaaaaaaaaaaaaaaaa

SEQ ID NO: 659 - DNA, 10759 bp, Human
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggcctctggggccctcaggagggccagcccatgagctggagctggaggcccgggatgggggctccccaccacgcaccagccactttcgactacgggtggtggtacaggatgtgggaacccgtgggctggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatcc

SEQ ID NO: 660 - DNA, 5688 bp, Human
ggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttttc

SEQ ID NO: 661 - DNA, 2857 bp, Human
ccacttccggttgttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttttccctagtgctggtatactatagagaaacccctggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacaggaaaaaaaaaaaaaaa

SEQ ID NO: 662 - DNA, 7455 bp, Human
cccgcctagcatggtgcggcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggccacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaaaaaaaaaaaaaa

SEQ ID NO: 663 - DNA, 2517 bp, Human
gtgcgctgaacgccccatatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaataaaaaaaaaaaaaaa

SEQ ID NO: 664 - DNA, 1313 bp, Human
tcgcgcccgcttttctctcgggtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagcagcaaaaaaaaaaaaaaaa

SEQ ID NO: 665 - DNA, 3633 bp, Human
cctctccagccgcccgccctccggccgcgtccccgccggccctgcagacgtggcggggcgggacccgctgggcactcccgcgcgtactcggccgcctgagcggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttccccttttctga

SEQ ID NO: 666 - DNA, 3184 bp, Human
atccaatgaaggttactggctgagcggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagtaaaaaaaaaaaaaaaaaaaaaaaaa

SEQ ID NO: 667 - DNA, 1554 bp, Human
acacacaccgcccaagcccggacggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggacgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggcataaataaaaacaga

SEQ ID NO: 668 - DNA, 2948 bp, Human
gcgggccggggcggggcctcgcttcccaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatca

SEQ ID NO: 669 - DNA, 2888 bp, Human
cccgagcctctctccctggccaggccccaggtctcgcagccagggatggagatggggggagggggaacctagagttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaatggcaaaaa

SEQ ID NO: 670 - DNA, 4127 bp, Human
gtgctccgctggttgaaagcggatccgggctggaggcggtgtcacggtgtatgaatattgattacgcgtcgcagcgcccagggcccagcgcccagcctccagtgcccgcccctctcggccgcccgacgctctctgctcgcgcttgggctcgcgatggggaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggcggtctatgcttgcttggtgcttatgctgacagtgatgacgatgacaatgatgtttccgaaaaactagcacaatccaaagagacaaatggaaaccagtcaactgatattgatagtacattggccaacttcctagcggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataatcctgaaaaaaaaaaaaaaaa

SEQ ID NO: 671 - DNA, 3207 bp, Human
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcaaaaaaaaaaaaaaaaaa

SEQ ID NO: 672 - DNA, 3057 bp, Human
gaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctatacaactgtgaaatacagatttttacccttttggcattgc

SEQ ID NO: 673 - DNA, 2685 bp, Human
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaa

SEQ ID NO: 674 - DNA, 576 bp, Human
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 675 - DNA, 622 bp, Human
cataaaccctggcgcgctcgcgggccggcactcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagcaaaaaaaaaaaaaaaaaa

SEQ ID NO: 676 - DNA, 1319 bp, Human
cgcgcttggccttgcccgcgcccgctcgcctcgtctcgcccggcctccccgcgtcgcctcgtcgcctgttccgcgccaggcatggcccccagcactgtggccgtggagctgctcagccccaaagagaaaaaccgactgcggaagccggtggtggagaagatgcgccgcgaccgcatcaacagcagcatcgagcagctgaagctgctgctggagcaggagttcgcgcggcaccagcccaactccaagctggagaaggccgacatcctggagatggctgtcagctacctgaagcacagcaaagccttcgtcgccgccgccggccccaagagcctgcaccaggactacagcgaaggctactcgtggtgcctgcaggaggccgtgcagttcctgacgctccacgccgccagcgacacgcagatgaagctgctgtaccacttccagcggcccccggccgcgcccgccgcgcccgccaaggagcccaaggcgccgggcgccgcgcccccgcccgcgctctccgccaaggccaccgccgccgccgccgccgcgcaccagcccgcctgcggcctctggcggccctggtgacccggcgggacctgcgggcgcgcggcccgacgaccagagggcgagcctgctcctctcgcctgtagggaagcgccttcccgccgtcgtccgccccgggcttggacgcgcccttctccggaaggctctggccccaagctggccggcccgcaggagccccattctcagagaatgtgtgtgcagagtccctgccgttttaggacaatcagggcccatcttctgccaagtgtctgaccccatggggttgttctgtgtttgcatttaagcaagtgacttctgggaagtccccggccgcccggggttctatgatatttgtagtgccggggctcgcacactgctgcccccagcctgtagaggactttcttcagggcccgtagctgctgggcgtacccctggcaggcgggctgtgccgcgggcacatttgccttttgtgaaggccgaactcgagctgtatcctcataggaaacagtgatcaccccggacgggcgtccaggaccctgagggccatggccaaaaggctcctgagtgtgcctggtggtctggctggggctcacggtgggctgtctggggagggtgggtgcctccactatgatccttaaaggattcctctgtgtgggtggatgcgtgtgggcacgactttgtactcagaaattgaactctcagtcacgtggaagccacgggactgctccgaagccgccataataaaatctgattgttcagcccccaaaaaaaaaaaaaaa

SEQ ID NO: 677 - DNA, 4622 bp, Human
aatgagcgcgcgccgcgtccggggccggctggtgcgcgagacgccgccgagaggttggtggctaatgtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctacagttaaaaaaaaaaaaaaaaaaaa

SEQ ID NO: 678 - DNA, 1934 bp, Human
gcaccgggttttattgggacacgccggcaagacgcctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgaaaaaaaaaaaaaaaaaaaaaaaaaaaaaaaaaaaaaaaaaaaaaaa

SEQ ID NO: 679 - DNA, 6704 bp, Human
ggcaacatgccagccccgtagcactgcccaccccacccactgtggtctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcct

SEQ ID NO: 680 - DNA, 7773 bp, Human
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcaaaaaaaaaaaaaaaaaaaa

SEQ ID NO: 681 - DNA, 4120 bp, Human
gcggcggtagcagcagcgggcccggctggggcgcgagcgcggcgcagcccagcccagcccagtccgagcgcggacccggcgcccgcagccccggcgccgccatggtggaggcggcgccccccgggcccgggccgctgcggaggacctttctagtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgatccgataccgcaaggaccgtgtggtggcgcgacgtgccccctgcttcccgacggtgaccagcctccaggacctggccagtggggccgcgctggccgccaccatccactgctattgtccccagctgcttcgacttgaggaggtgtgcttgaaggaccccatgtctgtggcggacagcctgtacaacctccagctcgtgcaggatttctgtgcctctcgccttcctcgtggctgccccctgtcccttgaggacttgctgtacgtcccaccgccactcaaggtcaacttggtggtgatgctggccgagttgttcatgtgttttgaggtgctcaagcccgactttgtgcaagtgaaggacttgcccgatggtcacgctgcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaagttgaaaaaaaaaaaaaaaaaa

SEQ ID NO: 682 - DNA, 7361 bp, Human
acgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagaagttatcaaggaggatgctgctgaggggctttcttcacccacagactcctcgagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgttt

SEQ ID NO: 683 - DNA, 1753 bp, Human
cagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccacgtgaaaaaaaaaaaaaaaaaaaaaaaaaaaaaaaaaaaaaaaaaaaaaaaaaaa

SEQ ID NO: 684 - DNA, 954 bp, Human
tttgatagagaagggacagggaacagaaccttcgccccccgcctgagcagctggtagactagatatcttccaaacattatctcatttacttccctggagttacaaataggtagatttcatgtccgttgaggggtgagaaagctgaaactttgagacttaagaatcctggccgaggtcagcctcctccgaagcttcatctcttgccaccactttctggtgcacacctaggacagatttcaatccctgagatcccaggatgaaacctatgtttgccaaataccagctactgtgccagaagagatcatggaaccaggtgtggaaagctgcttgagaagaggagccaaaacatcatagttgaaccgtcctggaatagaaactcgccctgaattctttcttgtgtgaaatccaagagccctctcttggggttggatcgggaccctgttcctgtaacaagtccacaatgccagagaattaaagagaaccacaaagctgaacctcaaaaagttagcctggcgaggggaggatgatgagatttcccctgttgtcacataaacaaggaagtaaagggggccccttgtgctctcagaactccaagcatgaaacgatagcaaagggaaaaacagctaagtgtttcctggctgaattttattttgctttcagtttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataaccccggatcgatggtactttttgaaaatgctttattgcaaaagagtggctagggttttacaagggctatgaagaaacatattaaggttaataaagctttttattgagtgtttaaa

SEQ ID NO: 685 - DNA, 3378 bp, Human
acagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaaaaaaaaaaaaaaaaa

SEQ ID NO: 686 - DNA, 2383 bp, Human
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagagaataaaaaaaaaaaaa

SEQ ID NO: 687 - DNA, 1880 bp, Human
tctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagtacatgccatgtgtccctcaactgaaaaaaaaaaa

SEQ ID NO: 688 - DNA, 1391 bp, Human
agccccggacgggagcgggcccacggggctgcaggtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaccaa

SEQ ID NO: 689 - DNA, 2564 bp, Human
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaaggtgtaatttttgtctgttaatcattcatacgtttctagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagcaaaaaaaaaaaaaaaaaaaaaaaaaaaaaaaaaaaaaaaaaaaaaaa

SEQ ID NO: 690 - DNA, 2429 bp, Human
acactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcaaaaaaaaaaaaaaaaaa

SEQ ID NO: 691 - DNA, 2859 bp, Human
aaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattattaaaa

SEQ ID NO: 692 - DNA, 2119 bp, Human
ataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagataggtgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaaaaaaaaaaaaaaaaaa

SEQ ID NO: 693 - DNA, 5100 bp, Human
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaaa

SEQ ID NO: 694 - DNA, 3149 bp, Human
cccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacattgcgtacttgaaggaccgaaggctgagtggaggagcagtgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaa

SEQ ID NO: 695 - DNA, 3114 bp, Human
caggcgcagtgcaggactgctccgagcacgcctacgcgcgcattttctccccttcctctccctctttccactttcctctccctttttctcctctcctttccccctcccaccacttggtctttcagtctttcagtcagttcgtttaggtctctccttccgacccccacccccagctcctctccctttccttttccccctccccctttcctttcccgtctcacgcgccaggccgcttgcacatgcgcattaggtacaaagcctcgctctttgtccccatctgtcgttcacacgaactcaagcctttggcattcggcagccaatagaatctaagaaatggcggaaaaatgattccgcctcgggagctaaaccttgattggcagtttagctaaccaatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaaaaaaaaaaaa

SEQ ID NO: 696 - DNA, 1916 bp, Human
atggcgccgtgcgtggcctcggcggtggcgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgttttataaaaaaaaaaaaaaaaaaaaa

SEQ ID NO: 697 - DNA, 3582 bp, Human
gccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgacgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaagaaaaaaaaaaaaaaa

SEQ ID NO: 698 - DNA, 7182 bp, Human
gcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 699 - DNA, 939 bp, Human
gtggccggctgggatcagcctttaagatggcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtaggggccaagcccccaccccatcccactccccttccctccccagatatttatgtgaaatgaactgcagctttattttttgaaataaaaacttttaaaaagcaaaaaaaaaaaaaaaaaaaaaaaaaaaaaaaaaa

SEQ ID NO: 700 - DNA, 1174 bp, Human
tagtttgcgttttcacctggtcgcccggcggccatggcggccgttctgaagccggtgctgctgggccttcgagatgcgccggtgcacggcagccccacagggccgggtgcctggactgctagcaagctgggcggcattccggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaaaaaaaaaaaaaaaaaa

SEQ ID NO: 701 - DNA, 1945 bp, Human
gattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaaaaaaaaaaaaaaaaaaaaa

SEQ ID NO: 702 - DNA, 2993 bp, Human
ggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtgaaaaaaaa

SEQ ID NO: 703 - DNA, 2752 bp, Human
accaattgggacatcacatccctggctctgggttagaaagctgacagtccttgatcctgtggccactgccccatcattcctgctcctgaggactcagtctcatggctgtggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtgaaaaaaaaaaaaaaaaaa

SEQ ID NO: 704 - DNA, 1411 bp, Human
attggacgccgccggtcacgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcacccgtatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaaaaaaaa

SEQ ID NO: 705 - DNA, 2340 bp, Human
gaacccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgtttctcaaaaaaaaaaaaaaaaaa

SEQ ID NO: 706 - DNA, 4392 bp, Human
agtggggaagaggacgggtcgagtgctggcttccggcggaaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagctccggtcttctgctgcctctgctcctaaacccagctgccggccttacagccagcaagtgtactctcagtggttcatttgtttatttgttcactttcaccctacagattttaaaaaatgaaatttttataactcaaagtgccttctctgtgccaagtactatgcctatttgtcaggagacaggaagccaacaaactacatgtgcctaatccagcccactgcctgtttttatgaatcaggttttattggaacacagccacgtccatttatttacatattgtccatggtggtttcttactgcagtggcagaggtgcgtaaggggctatagacacaatacaggctatggtccctgtattagggttttctagagaagcagaaccaatagggtgtgtatatatgtagaaagagatttattttaaggaactggctcaagcagtggtaggagctggcaagtctgcaatctgcacaacagaccagcaggctggagactcaggaaaaaaactgatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgttcacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagccccagagctgggcagtggcatgccccacagcctggccacctgcttcggctacgcaccatgcagcagctgcacctggctgcctcgggaaaactctgacctctctgggaagtggagccagtggctctgtgggcgtcctttcctgcagcctggagagcaaagcggctttccctgggactgtgtggctcctgtcccaactggcctccccattccacattcccattgctggaccagcaccaggactgggcacagggcttccttttgctgattcatttcccccctaactcattcagagttgagccccatctgagtccccacatgctggccctgaaacggttacaaaggctgaaaccagggatggcaggcccaggatcagtgctgtggctgttggagtgtcctctccaacagcatgacagccgcctccaggtgctcccagcatctgttgcagtcatggcagcctcacggcaacctctgaagaaggaattatagaaccaactttttattgttgaaaatggagtcttgtagagttcagtgatgggaaactaaagtagaaaaagcacatcacaaagaaacatatatagtacagtgtgatcccaattttgtaaaaatatctgtaatatgtaagcataggtatttgtatatcttaagaaaaaaagcctagaaataaagccacaaaaatattaaaaaaaaaaaaaaaaaa

SEQ ID NO: 707 - DNA, 869 bp, Human
gtgacagagcgctttacgacagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgtaaaaaaaaaaaaaaaaaa

SEQ ID NO: 708 - DNA, 4790 bp, Human
cctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctgagatgggatggtttgtgttttctcatgaagatatcccggcccctctgccaaccaaaaagctggtctagggtgcctaatactgatccatctggaccttagtgtcctcagtggtgattaaaatggccagtggggccactggggagggttggatatgctggcccatgagcatcttgctggctgaagtgtcaagcagttgtgacccacttggtttaccccatagtaggtcaagaccttatctctttccccagcttctaagtctggtctttcccagctcttaaaaggattctagagtctgccagtctctaccttctctcttctggcttaggacactataattttttcatttggacgttgtcctcccaccagcctcccagtcttctgcctctgccctgtaccatctcccagcagccacgcagtctttctgaaacgtatcccttccctgcctaaaatccctttactgactcttcatcatcaggacaaaaccctacctcctgaatgtagggtgtaagatcctgcttactccagcctctcctgtttcttgtcaccacccctttcctgcccctgacacaaaccctacatctcagtctcacaaaacacacaagttcttcacactccgggcaggtttggtagcaaggaatagagcgtactccagtgacagcaatcagtaggaagtttgcatccggagacacgcagcctgtctgcccctgtcttgggccacccgtctagacatttgttctctaacaatcagccgggttccttcaaacgtgtgctgcttatacatgctcattgtgtactgctaatgtcacctacttcccccttcattccccacaatgaatggatccattttccccatgttcaagttcccaagagagaatcgactgccactgtaattttttttcctaatcactcataggttacaagtacctaccctggtccagtgaactgcgggattcatatgtggccacttaggctggtctcgttggtatggagctgtgggagggcagcacccagaaataggctttgttccaggcctggcacgtactcctcctgctcctactttctctacctgggaaatagccgctcaggacgaagctgctgctgtggtgtcgccacctctgagaagtctcccagaccctccgactgctctttaattgcctgttctctcctctggaagccttcccccaacacagaaaaattcaatcccatcatcaaaaagggctttaggttttccctccatctttacgtgttgatcaaagtttgcagatctgctggaatccttattgaaaactccccatttcaaaccaacccggtctacagcctccagggaagcttcctcctgggctttggctccatgttttggtagagggtggaggctttgggcagtgctcaaactccaccgggaagtctctctcactgagcagccctcctgcctgtcatcctgggcaggcgagcactctgaggccccagtgtagctctgtgctttgatattcccaagctctgctggggcctgactaggccagccccaaggtggccagagttctggcttcatacctgagccaaaagccccaatccatgcttggccattgcctgagtattagctgccccagggggatcacggtccccatatatttgcttgccatggaccctgggcagcagggagagagtagagatttgtcaagagcccatggtggaggctgaggccctgaggccatgagatgcaggcatggggtgagaaacaggccccttggaattgggctgggccttggcccagcttagtcaaatcaaaaggcttctatttggagagctgaagagggtgtacagaggaaggggctaggtctgcaaggagtgcctcatctccctgaagagctctcagtggaacatacttcacccatccatgtacccacatctttccttgcccagaaggcgagagccagctataacagacccatttcaataccctggcaagtcattactgcccttagctcttggtgtccccatctgtgaaacatgggggacagctgctagcctggattggaacttgggcaaagtccaaagaatgggatttagagctgaatgaacctcacactgagggcacaatagcactaggcactgcccccagagcctagtgctatatgcctgctgcaggtcctacccaagcatgctttactgaggaactcaacgtttcagagcttgagggtcaggttgatcatgggcttgtgaccataggcttccttagtatgccaggcttggagaaccgtgagaaaagcagggaagataccttcaagggtagcaggcatcagctctactcaccttggcccataaggctttgcctggtcatgctggcaccgggtcatatgctggacagggagaacgagagtcccatcctggaactccagaaaagcccctggatgctccagcccctgggaaagcacacagccaggcccttgggtgggaggttggcttctaacagtgcatacacatgcccttcctctgagtcggggcagcaaaaacatccattccgctgcgcaacagttgtcatttttctaacatctgaaaactccagaaggagatggtgataaatgtggtaccggattctgcctaaaggatcagtctttagatgttttcagattgaaagcctcatttgtgatcctcacagccatcttgaaagaatagagcagccagtgggtatactggattgtgagctaagaggcctgggactttccccctgttgctgccagccaggttgatgaccctgggcaagtctttttccttaccaggtctcagtttcctcagctgtaaaatgagaggttgatctggatcagggatagtaaatgggcctttgttcagttactgactgttgtataacaaaccacccccaaatttagtagccttaataaacatttattagctcctgaaaaaaaaaaaaaaaaaa

SEQ ID NO: 709 - DNA, 3178 bp, Human
cttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgaaaaaaaaaa

SEQ ID NO: 710 - DNA, 4496 bp, Human
cttccggacaggtcaggccaaggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggctggagtgcagtggcgtgatctgggctcacctccctggttcaagcgattgtcccgcctcagcctcccaaggctgggattacaggtatgcaccaccacgcccggctaattttgtatttttcatagagactgggtttcaccatgtagaccaggctggtctcgaattcctgacctcaagtgatccacctacctcggcctcccaaagtgtggggattacgggtgtgagccaccacgcccggctaattttttgtatttttagtagacagggtttcaccatgtgggccaggctggtcttgaactcccaacctcaagtgatccacccaccttgttctcccaaagtgctgagattacaggtgtgagccaccatgcccagcctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgctggtttgcactgggcacggggactggagagccaccaggccactgagcgcagcatgctatcacttctcaggaagttgtgagggtgaggagaatagccgggcccactctgcagaggggaggaacaggcacaggctagaggcacgggctgatagagtgagtcctctccctcattcattcattcattcattcattcatccatcagacacctgctgggcatctgctgtgtgcgagacactgtgctgggtgccccagacacaagacagaaactcgggtcgctctgtgtgcctccacactggccttccctgctgcgtggacgcaggctctgtctcctaggctttaagccccatgcatcaggtggaagacaatttccagcagcctctgcccgcttgtttttcctcctctccttttcctgccgccttggtcttttttgtcttttgtgcagggccgtctctcgcagcgcccgtctgtgctccgcagcgtctaggaaaggattagtgtgagcagagcacgcaggctttggtgaacagagccgagcttggtttcaacatctaattcaatttgttctgccgagattgaaatatgaaatggttgccagtcaaacgttcaaaggacggggaagggagagtgagcgcatgctgaaatttaaattttaatgaaaatgactttaaccctttggtacaccttgcaaaatgtaacccatcctcccatcctgtgaaagcggcctctcgggttagagcttttccacccacttctcttccactgagcttcactaataatatgtaatcatttttttcagccgtcttaataataaaagattaatagaatgaaaaa

SEQ ID NO: 711 - DNA, 9443 bp, Human
aaagcagtatgtgctgagagaggaggattaagctcctggaggcagagctctcccacacacttgctggcttgctgggctccactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaacaacacattgatatgtggaaatattctataaggttttcttttgttcccttagaattcattggagggatgcagtaaaaactgtagtagaaaccttgaaacacccatatgtgaaaaggtctgtggaaattgaggcctctacattaaaagtgcagaaccaactgttttacagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacaga

SEQ ID NO: 712 - DNA, 4035 bp, Human
aacaacaaccaccacaaactccgaccgtcctttccaggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaaa

SEQ ID NO: 713 - DNA, 3185 bp, Human
ggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgta

SEQ ID NO: 714 - DNA, 5201 bp, Human
ccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgactgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccacccagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctccaaaaaaaaaaaaaaaaaaaaaaaaaaaaaaaaaaaaaaaaaaaaaaaaaaaaaaaaaa

SEQ ID NO: 715 - DNA, 1147 bp, Human
gtggctttgccctttggcctttgctggctgtgtggcggctccgcggttcgcaggtcgttcgctgagcgtctctgcttagccgcggtcatgagccggcacagccggctgcagaggcaggttctgagcctgtaccgcgatctgctgcgcgccgggcgtgggaagccgggcgccgaggcgcgagtgcgggcagagttccggcagcatgcgggcctgccgcggtccgacgtgctgcgcatcgagtacctgtaccgccgcgggcggcgccagctgcagctgctacgctcgggccacgccaccgccatgggcgccttcgtacgcccgcgggccccgaccggggagcctggcggcgtgggttcccagcctgacgacggcgacagtccaaggaacccccacgacagcacgggggcaccggagacccgccccgacggacggtgacaggcgaagagccgaactcgctcgatggcgtggtggagccaggaggctcgcctgactgcatggggggactggggaacccgcctaaggtgagaggtcttaagagactagcttgacgaattggggatgtcagagactcctccttggcgacgcagggggcctagagagccccgtgatggacggcaagggaggcccgccttttccgatgcttggagacaggtcggtgctcctcccccatgagggcttggggcggcctgggacgctggcgggctggacagtgtcaagccaagagctacttgcccgaaggtacggggagccaggacgacccccggtggacagggagagcctgagacgcccttctcttgacccctgagaacatacccacttctggctcctcaaggagtctcccctctcctgtatttaactctgagaagtgcagactttttgctgagaacgttttgggaaggtgccctgatgagcggtgagaagcccggaatccccttctggaaaactttcccccattaattgtgacaagccaggaccatgaggaaggggtaggggtctatcaccctggttgatcaactgaagacccccaaaggcccctacttgatggttttgaggggcaacattgactcatttgccccttccctctcggaatgttggacaaagggaataaaattggggatatgtctacttcccaaaaaaaaaaaaaaaa

SEQ ID NO: 716 - DNA, 2116 bp, Human
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaaaaaaaaaaaaaaaaaaaaaaaaaa

SEQ ID NO: 717 - DNA, 4298 bp, Human
ggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaa

SEQ ID NO: 718 - DNA, 3073 bp, Human
tgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaa

SEQ ID NO: 719 - DNA, 1131 bp, Human
tggagagagcggctctcgtggctggggagttggatgcaccaaacctgtgtgcggctggagagggaggcttctgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggcaaaaaaaaaaaaaaaaa

SEQ ID NO: 720 - DNA, 3465 bp, Human
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 721 - DNA, 4577 bp, Human
agctgtcgcgggcagccgcctcacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaaaaaaa

SEQ ID NO: 722 - DNA, 5238 bp, Human
ggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttcttaaaaaaaaaaaaaaaaaaaa

SEQ ID NO: 723 - DNA, 3249 bp, Human
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaa

SEQ ID NO: 724 - DNA, 2894 bp, Human
gagaagctccgcgggcccggctgggcgagtgtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattttcaaaaaaaaaaaaaaaaaa

SEQ ID NO: 725 - DNA, 3949 bp, Human
ggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccaaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacacttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagctcttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcacacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataattgctgtatttgtgagaaagatctgttttcttttagctggccacttcagtttgctgcgtatctttagctgctgttgtgcttaaatactgagtcatagggtgcttttttaagaggcccttcagaatatacttgtaaaggtgtattggcattttttggtttataagataaaaacagggcatgaagagccttcatagtattaggccaaataaaatctattaataactgccagctagctctacacttatctaaagctgttaatgttcctttttttctatcaccaaatttataaaggactaaacagtactattgagtttactcggtttataaatccagttttaactataattcaacaatattttggtgtggtgaaacgttgtttatgaaatgtataaaatgtataagttttaatcaactgggaaatgatatttgattgatcttgtgttttgttgttttcaaatgaaaactaggaggtaattaatacctttctctagtagtggtatagaggaaggacagatgctcattgttgaatctcttaaatttttccagctaacctcagtttggaagaaaaatgtattaaagggttataaagatcaaaaaaaaaaaaaaaaa

SEQ ID NO: 726 - DNA, 4562 bp, Human
ggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaatgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggg

SEQ ID NO: 727 - DNA, 679 bp, Human
gcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttacaaaatttttaaattaaccttttatcattaaaccacatagactttatgacag

SEQ ID NO: 728 - DNA, 3715 bp, Human
gacgtcatgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgctacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctatgttttttaatagaagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtgtttaaagcatttgataaggtttaaatgttttttatacagagatttttgttcattaaactcaatctgcatcatggtctaa

SEQ ID NO: 729 - DNA, 3431 bp, Human
gggggaggagggcggtcgtccggggttaggttgagggggggcgtcggtccgttctgggcgggggatgactcacagcccatcccatctcccagacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttgaaaaaaaaaaaaaaaaaaaaaaaaaaaaaaaaaaaaaa

SEQ ID NO: 730 - DNA, 2104 bp, Human
gtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaagacttcaccctgccgttcccaggtcctccctgaggcgggggccggagaggacagtcctgggagaaacatggacactgcacttgaagagcttcagttgcccccaaatgccgaaggccacgtaaaacaggcaatgttgtttaatgtagaaaatggaaccccagcttcacgtgaagccttgtggttgagtgaggagtgaaggatggggaggaggcctctggggaaggggttccctccctcctgaagatgaacacacaatacacggaagagcgccagcctctgctttcaggaaaggtttattgtggtgagtgccttctgtacagtcgactgcaaatgaaacgcagaggatgggtgcccagaagcacctgcggcagaggcgcacgggaagcccggggcccaggctcatgcaacacgacgctcaccgcggctcgggccgtggggccgtcagagaaacctttttaaaaaatggagatgaatgttacagaattggacaacccgaactgcttttcaaaaccagaggaaggaggttcttagccgttactcagataccagtgctggggagggaggcctgacttcagcaacagctgtgggtgggctggaggccggcgcagcttggggccccccgcgccagctgtctcagccaccacctgtgcggcgcttgctccgaggggtcagcaagagcaactgatggctgccacttccaggccccgagagacaggcctcacgtaactttactgcagccgaggtccaggccgtggagggggtcctagctccgctgcattctgcatcccaagtgggcacgtggaggaagggtctgaaggaaggctccggagcacaggccctggtgttcctgtgaggacgctggacctgcaggagcggggagctgcagtgccacctgctgggtaccacgggccgggcctggggtccacgcctttgggttgggtgtgtctgatgtcttgccaagcgcctggtcctgtcctcttgagctgcccttgcccagcactgcactctggaggtgggtggtgcaggcggtggagggacacaggccagctcaagcccgctggtggcagggcgttttcccaccgggatacgggaagccacctgtgtcagggctaggccctgggatcgggagttacactaccctgtcccaagccgagggggccggtggaatgacttgagcagctctgggagtggggaaaaaagacgactaatttccaaacccgtttgttctcagataaaaagcagttttataaacccgcaatctgctccagattcaagcagtaatatttcagcaagaggaggtggtcatgggaagccagcacagcagaggctccctgaccgggaggcctgcctgcttttcaggttgtttcccatgttcagcgtggactgcagaagtggctcacgctcctgtggtgagggcagggtgctccacagacacctccagacccagccaagaactacagggcggcgggctgcggtcagcacgtgtgctcgggacacagcggagtcagggccagagcccttccctccaggaactgatccttgggaaaacagccatgggccaggctgcagtctggttcccagtggggctgcctcagtcctacccccagcaccctcaaaagctggggtgtctgcatgtcccttcacataattgataatggtaccaccttctataataataatataaaataaaaacaaaaaaaaaa

SEQ ID NO: 731 - DNA, 2261 bp, Human
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaaaaaaaaa

SEQ ID NO: 732 - DNA, 1566 bp, Human
ggggcgccgccatcgcacagagaggcctgggcggggcggaccggcgctgggcagccaggacagccgcggcagccgggtccgcagggcagcagccggcctctcccactgcagccctcccgcccgcctaccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatgtgtgtgtgtgtgtgtgtgtatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgagcaacagaaataaatcattttaaaagttctca

SEQ ID NO: 733 - DNA, 1884 bp, Human
gtagcggtctccgcagccaggattggcgcccgcgcgggccttcgagccccgcccgcagagccccgcccgcaaagccccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttaaaaaaaaaaaaaaaaaa

SEQ ID NO: 734 - DNA, 3662 bp, Human
gggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaaggtctttgcagatgtaaataaatttaagatcttaaatgaga

SEQ ID NO: 735 - DNA, 4940 bp, Human
cggggcccgggaggggcggaggctggggccagacgcctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgtttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaaaaccttgattgcctcctctgtcacatgccactcttggagctggagcttagtgatatgtcaatgagagatactcttgtcttttttttttttcttttcttttttttttttgagttgaaattaggtaaaatctcaactcaaaaatcaaactcagggaagaggcccactgaggagaacaagtcttctgcattttcttcctgccctgctcccaccttctcgcctctggctgcttggatagcttggtgactccttcctcaccctcctgcttctctgtctctccaagaagccagagctgcctctttccttccctggaagagattttatgggatcgcttcctgatagaagatgggaaggagagggcagaactttgcctgctgtcatatctgaagaatcactggttctttctgcatcccaggggcgtaactgatctgactccttgggctttttcctgtattgtggaatatagagtggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagtatcctgaggacacagggcccctggccttgatggcactgggctgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcatccctgcttctggtcttggccacttggcaatcatggggaagttgactccccgcctcacttgggcttggagctggatacttgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggcaaaaaaaaaaaaaaaaaaaa

SEQ ID NO: 736 - DNA, 2201 bp, Human
gtagttctgacatgtttagggagtggagttctgctaaaaagactagactaggacatttttaggcaagatggggaaactaatccagaaaaagaaaccgcaccgctacttagcccctggctccggacctgcctttcttttttaaatcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaggagttttgcacgtggatcgccgttcgggtgggcgagatggagacagcccccaagccgggcaaggatgtcccgcccaagaaagacaaacttcagaccaagagaaagaaaccccgagaatggaagaacccggagtcccagcgcggcttgtccgggacccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttggataatg

SEQ ID NO: 737 - DNA, 2247 bp, Human
gttcccctgcagttgtttgggctgtccctgtggctggttctggggtgtgcggccagccatggagcgctctgggcccagcgaagtgacaggctcagacgcgtcgggaccggacccgcagcttgcggtcaccatgggcttcacggggttcggtaaaaaagctcgcacatttgacttggaagcaatgtttgaacaaactcgaaggacagctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaaaatcctgttcacaagattcctgactcgcatgagataacgctgaagcatggcactaaaacagtgtctgctttgggtctggatccctcaggtgcccgtttggtgacaggaggatatgactatgatgttaagttttgggattttgctggaatggatgcttcttttaaggcatttcgatcccttcagccctgtgagtgccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 738 - DNA, 4816 bp, Human
aagtgggggggcccggctagccattctggaagcggccgggcgcagtcttcgtagcgtacccgccggctgcgaggcgcagggcggaggcggagactgcgtggcgcaggcgcgttgctgggcttctcctgggtccccagacagctggaggagataaacagaggaggaggagggaggggagtgcgtgtgtgagagcgcgcgagggagtgtgagtgtgtgtgagcgcgggtgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttacacaataatatttacccttgct

SEQ ID NO: 739 - DNA, 4087 bp, Human
ggacgggggcgggcaacgccttagccgcagccccggctggctccggagcccggccgccttgccagggcacagtccgccgagagggccgggcggggtccgcaggccgctgcccgccccgctagggcgtccaggagcggggccttggctagtcagtctcccggacgcagccacggccgcccccgcgaggctgcggcgtctctccagcgagcccgcctcgggcccgagcctggggtcttgtccctgaggagcgccgtattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagct

SEQ ID NO: 740 - DNA, 3410 bp, Human
gggcgcgggcagctctgcgtccgaagctgctccgacgccgtcgctgggaccaagatggacctcccggcgctgctccccgccccgactgcgcgcggagggcaacatggcggcggccccggcccgctccgccgagccccagcgccgctcggcgcgagccccgcgcgccgccgcctgctactggtgcggggccctgaagatggcgggcccggggcgcggcccggggaggcctccgggccaagcccgccgcccgccgaggacgacagcgacggcgactctttcttggtgctgctggaagtgccgcacggcggcgctgccgccgaggctgccggatcacaggaggccgagcctggctcccgtgtcaacctggcgagccgccccgagcagggccccagcggcccggccgccccccccggccctggcgtagccccggcgggcgccgtcaccatcagcagccaggacctgctggtgcgtctcgaccgcggcgtcctcgcgctgtctgcgccgcccggccccgcaaccgcgggcgccgccgctccccgccgcgcgccccaggcctccggccccagcacgcccggctaccgctgccccgagccgcagtgcgcgctggccttcgccaagaagcaccagctcaaggtgcacctgctcacgcacggcggcggtcagggccggcggcccttcaagtgcccactggagggctgtggttgggccttcacaacgtcctacaagctcaagcggcacctgcagtcgcacgacaagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagccacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtgaaaaaa

SEQ ID NO: 741 - DNA, 2322 bp, Human
cccgccccctctcttctccctccctcctccttccgtgtgtccctccccgcccggctggaggctgctccggaccgggacgcagagtctgcggacccggcgccgaggcggccacccgagacgcggcgcgcacgctccggcctgcgcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaa

SEQ ID NO: 742 - DNA, 4656 bp, Human
gggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatgctctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaa

SEQ ID NO: 743 - DNA, 2090 bp, Human
ggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcaaaaaaaaaaaaaaaaaa

SEQ ID NO: 744 - DNA, 2172 bp, Human
aatcccttcaaccttctgcgcgcttccgccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccaaaaaaaaaaaaaaaaaaaaaaaaaaaaaaaa

SEQ ID NO: 745 - DNA, 1317 bp, Human
cggagtgacagccccacgggccacgcagcaagcagaagatccccgggagtcaccctcaaccctctggggccacgtgggcccatgaataccagcctgtctgcgagttagacgccagtcctggtggcccgggaagcccagatccgcatcagcggttctgcaccccacaccagcatgtgctcactgcctgtgccccgggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccagaaaaaaaaaaaaaaaaaa

SEQ ID NO: 746 - DNA, 6772 bp, Human
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaaatcatgaaaaaaaaaaaaaaaaaa

SEQ ID NO: 747 - DNA, 3223 bp, Human
gccgacgtcagcgcgccggggcggggctggcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctgcttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgaacgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctgtccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacattttaatttgacttaatattttaaagattgaatccagatcacttgttgctgtcttaatggaatggttttctacaggagctgtaacatacttaaaaatatgaatgtattatgtaaatatggcttctttacataaaaaataaaatgtcaacactgtacttttctgaacacaaaaaaaaaaaaaaa

SEQ ID NO: 748 - DNA, 3621 bp, Human
tcataatagaattctcatgagatctggttgtttgaaagtgtgtagcacctccaccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgatcattatatcttgttcataaaagaaaactttccacattgttttaacaaaccccacagctgagagtcaggcctgaatctttgatgtgtgcccattcacaacgttgaccctattggtttgtggtggggcaggacatcgaagatatcattgactcatcacattcccctgaatagctcatatttagaaaatattcttagattgtaaaaatgtactgttcatttgttatatgcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccatgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttcaatggaagatcataatgtgaactctgcatctccatgttaaagtttaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacggctgctgtgggctttttccagttcttcaccatccatttttataaaactcttattgttaaaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaaaaaaaaaaaaaaaaa

SEQ ID NO: 749 - DNA, 3631 bp, Human
ctcttccgcgccggcaggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaactctaaaaaaaaaaaaaaaaaaaaaaaaaaaaaaaa

SEQ ID NO: 750 - DNA, 3241 bp, Human
ggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagcaaaacagaatgcatccatttagagatgacagacgaagtaaatcaattgaagagagagaagaggaatatcagagagtgagggagagaatatttgcacacgattcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttca

SEQ ID NO: 751 - DNA, 4056 bp, Human
ggtctcgggttgcgcgctgggcctggagggagggggcggcccccgcaccggtccgagttgcggccgcgtggactgcgacccgcgccgcgccgcaccgcgccgcgccctgggaacgccgctccccgcgcgccaacggacccggggaagcccttctggggtccgaggccgcgctgcggggccgcccacgctgcgctccaggagccagagcctgcagggtgggtgtcgggacatgctgatcttccctcaagacagctggcgggcgctctggtcatggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacggtgtggggggtgccccacaaggcccagccctgggcaaggaagctttggaagcagcaaggtgggggtcaggctacaggtgccccacctccccagagccctgcagtcacgtgaggcccctgtgcagtagagagcctttctccagcccatgctggctggggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccaaaaaaaaaaaaaaaaaaaaa

SEQ ID NO: 752 - DNA, 2347 bp, Human
gttccccgcgtgccaccaggaagctcgggccggccaagagcgtagactcttgagaggagtgagacaggtgcgcgccagccggccttcggggctttatgggaactgggccgtgcggcggtcccgccctcgtgcgcaggcgcagaaccgttgtgaccagagcggttgcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataaaaaaa

SEQ ID NO: 753 - DNA, 815 bp, Human
agagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatcaaaaaaaaaa

SEQ ID NO: 754 - DNA, 2859 bp, Human
gcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacataaaaaaaaaaa

SEQ ID NO: 755 - DNA, 2608 bp, Human
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaaaaaaaaaaaaaaaaaaaaaaaaaaaaaaaaaaaaaaa

SEQ ID NO: 756 - DNA, 1729 bp, Human
gcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgtccaaaaaaaaaaaaaaaaaa

SEQ ID NO: 757 - DNA, 2589 bp, Human
gtcggaagtcaaaggtcagtaaatagtggtgatgtcatgcaggcaagatggcggaaggggaggacgtgggatggtggcggagctggctgcagcagagctaccaagcagtcaaagagaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaaaaaaaaaaaaaaaaa

SEQ ID NO: 758 - DNA, 2402 bp, Human
gagccgctggcgccactagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctcattttggttttgctttgaaggaagaagtaaatgaaaaggggcaggacttattaaagcccatcagttccaaaaaaaaaaaaaaaaaa

SEQ ID NO: 759 - DNA, 900 bp, Human
tttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgtaaaaaaaaaaaaaaaaaaaaa

SEQ ID NO: 760 - DNA, 694 bp, Human
gacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgcagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacaaactgtatgcaaactaataaaactattctgaagaaaagaa

SEQ ID NO: 761 - DNA, 1203 bp, Human
ccgcgttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggcggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaaaaaaaaaaaaaaaaaaaaaaaaaaaaaaaaaaaaaaaaaa

SEQ ID NO: 762 - DNA, 1654 bp, Human
agcgtgctgcgtcacggcggtgcgccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctcaaaaa

SEQ ID NO: 763 - DNA, 3148 bp, Human
cctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctgaaaaaaaaaaaaaaaaaa

SEQ ID NO: 764 - DNA, 7222 bp, Human
agccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 765 - DNA, 7650 bp, Human
atggtggacgcgagcggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaaaaaaaaaaa

SEQ ID NO: 766 - DNA, 1591 bp, Human
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtcctccagggtgca

SEQ ID NO: 767 - DNA, 2147 bp, Human
actgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgctgtaaaaaaaaa

SEQ ID NO: 768 - DNA, 2194 bp, Human
gggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaaaaaaaaaa

SEQ ID NO: 769 - DNA, 1693 bp, Human
ggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctcaaaaaaaaaaaaaaaaaaaaaa

SEQ ID NO: 770 - DNA, 3341 bp, Human
tgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaaaaaaaaaaaaa

SEQ ID NO: 771 - DNA, 2070 bp, Human
ctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagcttaaaacctctactgcggaaaccaaatttaatagaattttaatgtcatttcagcctataactccactacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcccttcctcattcaacttgttgccaacagcatggcccctccagcctagctgggtgcctcacagtgctatgtgcacctgactctcatgtgtctgcagatcaaaccaataaacatttaggaacacc

SEQ ID NO: 772 - DNA, 3096 bp, Human
gcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcaggtcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaaaaaaaa

SEQ ID NO: 773 - DNA, 2956 bp, Human
gacagggccgcggacgcccgggcagccacggcggcggggccgcggcgggcgccggctcagcccgcccctttctcccgccgcctccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaa

SEQ ID NO: 774 - DNA, 1977 bp, Human
ggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgctcagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcattccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtccc

SEQ ID NO: 775 - DNA, 1597 bp, Human
gaggttcgcattttatagtcttcggggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggtcaaaaaaaaaaaaaaaaaaaaaaaaaaa

SEQ ID NO: 776 - DNA, 2545 bp, Human
gaggggctgaggtaccgcccgcgcgagcacacacagacacacacacacacacacacacacacacacacacacatcttccagacccatcccctgcctgccagctccacgagccagagagagacagagcgcggacgccgcaggaggcagtgcctggaccccagctgcccaggagagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcacccccagttgtgcccccgctccactcccccaagtccccagtctggcccaccttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgacatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggccgggggttggggagccacacagggtgaacgggcagcagccggctccatgccccactgccctggctgatgagtccttcggtggcctcagtgtgcacgtctgtctgtccgtctgtgcttgtggctatgagcgtgtgcctccacccaccccacgacccgtgactactgtgcaagctggccaggaggtaggtggagggcaaggccaccagacctggcttcgcgctgtccactgcctctctcctcccctccctgccgcagacacgcaggacccgctcgccctcctgcttacccgtccccacggtgactgagctgcgagagcctgcgctgggctcactccctggcctccgcccctgagctgtcccgtgtcagtccctggcccggagccaggctctctgtgctacttacatctccctcccttggctgaggtcccccgccacagcctggacccttccctcagaagcctggccgatgggtgcttttggggagcctctcagcctctggcaggggaggaggactgacacggaggcacacaggcctctcactgccgaggccagccttccttcctgctctgctctctcagtgccatggagaggcaggaagaggggcctgagggcggaaggggtttggggctcccatttcgccggccagtccctcctcctcagcctggcagtggcgctgggctccttcccctgggctgtactgagccgagcccaggggtttgcagagggtgggggtccatctctccagcttggctgcagacctcctttaccctgactcacaagccccactgatgctctgggccatgcccggctgacggctgctgtggatgccgcgagggacggacacacgtccggggcacccacgaggagggcccccagcctgggagactggccctgcggcctccacgtcaaactctcttcccaaagccctaacagaccagtggccgaggtgtggctcttattgcatccatccctgaagatgtgtggctgttgctgtcacctggagtccttttggggccaagatgtgtgtgcacccggggtcgtggccattcactcccaggcaggggtgagggtggcctggcccaggaggccaggaaggagggccctgtctgcctccacctctgggtgcaccccctgcctaccaccctcccttctagagagcacatcgcctgaccggggagaagtggggccgtggttcgagggagggctggccaggggtgggacccttatgagactcagtctgtgagtaaaactgggggctcaaatgcccaggatgaggggatcagtgactgtctaggaggatcccttgccttgtaggtgccccaagaccgcagggtagaaatcagccgggatgcctgcatcccacccccggccccagggcccaccacataaaatctgggagcccagagctgctgaggtgtggtcagctcccctaaaatgggcacggcccagcctgtcccatgaggaataaaggcccctggcccccttgagagagggcttgttggtgagggctgactcctgggggcccccaaggctcccctcctgtggggaggccaccttttaaggcaccactagcagtcaggatatggtggcatcagccctggggcctcctgggtggcaggggggcagcagctctcctccccactcacaggccctgcagtgctcatttggaattcctcccaagacccctggccacccagaccccccattcttcctaacactggcaataaaccctcaactgtgacccacaaaaaaaaaaaaaaa

SEQ ID NO: 777 - DNA, 2025 bp, Human
gttctgcgcatgcgccgaaggggcgtggcggtcgcacctgcgcgagttgggggaaggaggaggggcgaggtgacgcaggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggcatcggc

SEQ ID NO: 778 - DNA, 4390 bp, Human
acgagatggctgtgtgcgcaggcgcaagactagcgctcttgggaccggaagttaaggcgttcgcggcgtgtgaatccagggcctgaaaacccagaatgaacttgtgtccatcccagagatcactgcagatgtcatgaggtaccctttgtgtcaccagctcaagcaggcctctggccactttatcatctgtggtggtcctgtgccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggaaaaaaaaaaaaaaaaaa

SEQ ID NO: 779 - DNA, 1363 bp, Human
gggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaattgtctgtaaaaaaaaaaaaaaaa

SEQ ID NO: 780 - DNA, 2639 bp, Human
ctgcttcctgcacgggtggtccccaagcactgcgggaccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgataaaaaaaaaaaaaaaaaaaaaaaaaaaaaaaaaaaaaaaaa

SEQ ID NO: 781 - DNA, 1204 bp, Human
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctc

SEQ ID NO: 782 - DNA, 2558 bp, Human
ggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactggaa

SEQ ID NO: 783 - DNA, 13109 bp, Human
gggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagagaatatagcttttcatagaaattattagaaaagcttacatatttcattagagagcccagtttgttagactacatttattccgtaaaagttctatatacaaatgacaacccatagtttatcatgtaaatctgatttaactgttcccttcaattccaagaaagatttcttcagcagtagatgacaattctaaaagcataaagaaataactaataaaggagatggatgatgttataggttggtttggttgggttttagtaaatagttattcttctaagaaggcttagaaaatcgagaattgaatagttggtactttgaattccataggaaaaagcactcagaagaaaaagtctacattggctagtgtttagattgagagttaattttcccatcaagtccaaaagtttccatccaagtctatagaaactgagagaaaaggttcttggcttacacttaaaatacacattgttgcaaccatataagagagatacattacagaacgcttttaaaaatttggtctcttaagcgcctaacagtccatgctttagtcacatctgtgaaacctcttttctttttttctttttcttttatttttttttttaaagattaaaggcattttaaaaataaatgtttcatggccgggcatggtggctcacgcctgtaatcccagcactttgggaggctgaggtgggcagatcacctgaggtcaggagtttgagaccagcctggccaacatgatgaaaccccatctctactaaaaatacaaaaaaattggctgggcatagtggtgggcacctgtaatcccagctcttcgggaggctgagacagaagagtcgcttgaatccaggaggtggaggttgcagtgagctaagaccgcgccactgtactccagcctgggcgacagagcgagattccatctctaaataaataaatgtttttcaacgtgttttatgtgagaaataccagcttttcattattactaccagttgatctcaggtgtcacttggttggttctgctgaccgaggcactgggcattttaaatatggagtttccctccacccattgatcaagtctgaggtttgtccatccttggtggcaggctagcttaaccatggattcacaaaccccatttgattgtcgtaagtcataaggccaccccagtgccagtggttgggcatcacagtgagtctgaggtgatgaatttgagttagctgtaggctagttccgcaactcagcaatagcccatggatggttggtaaaagacgttgactttgccacttaaatttccaggagaagaatagcttatagtttatctgaggaaagtaattgggaaggcttagatattgagaagaaagccctgttaaaatctaggtagcatttcctttcttctttattactagagggatgggaggttcaggcctgagtcaggactttacaatttggtgtccttcccagaggtactttgggcttgatcattttaagtttcaattgcaaaaaaaaatttttgacggagtgttgctctgtcactcaggttggagtgcagtggtgcgatctcggctcactgcaacttcccccccctgggttcaaagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatggtaaaaattgttattgagtccatgtctttgccaccttgttggacttgatttccctttctctgtgttcctcccgccctcagtctctctcagtctgtccttttttgtgtgtggagttgtgggcaggtcattggactgggactgactttaccagttttcaggctgtggggctagtcagtcattctctctgagccttctacctctaaagttgagttctttttttaaattctttttgttttgtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattc

SEQ ID NO: 784 - DNA, 2204 bp, Human
gtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaataaaaaaaaaaaaaaaaaa

SEQ ID NO: 785 - DNA, 2610 bp, Human
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccatcaaaaaaaaaaaaaaaaaaaaaaaaaaa

SEQ ID NO: 786 - DNA, 3465 bp, Human; identical to SEQ ID NO: 720

SEQ ID NO: 787 - DNA, 1824 bp, Human
gcggtgagggggcgggcccgtacgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctttcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctccccaaaaaaaaaaaaaaaaaa

SEQ ID NO: 788 - DNA, 5030 bp, Human
attgaggagcagaaggagtagggtgcgggggaggaggaggagcgcctttagtgctgcagcagctgctgctctgattggcccggtggttcagctgcttccctggaacaaaaggtcaaagtggactgcagtgtaaatgtagagaagcagccgataaaatagcattgcctgaagaagtttggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttca

SEQ ID NO: 789 - DNA, 1464 bp, Human
cgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaatgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaaaaaaaaaaaaaaaaa

SEQ ID NO: 790 - DNA, 7048 bp, Human
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctggaagacataaaaatctttaaaaaaaaaaaaaaaacacttttgaacaagtcccttctttcaggagggttgactttagacaattaactgtgttctgtgctctgtcattcagattgcttcttgctaattgttttactcttgtgcctgaaaatgttagtgatacgaattgacactttaatgttgtatgcttggtggggatctttttatcacaaggcattttccaagagtcatatgttgataaagggatatatgttgtccttagaaatcacacaaatcatgaccacaataatttatctgtaactgctgctaattttattgagcagagaaaaaagaatatacatatataaacatgtataggtgcatacacaatacacccggatatgttttacacataattttgattctgatattttagataacatctgttcacttttaaacaatctgttgaggttttgggactgttatctacattgattctcttaggaatagtggacagaatgactccaaagattctcagaaccctgtctcttgaagctcaatcttatttgggttcatcactgaaaacttagaacaaatcagtaaagaatcctgtattgaagaattaagtttgagtttaagcccactcaccgcagggctggtttttgcatgtaatactcccatgatgtctggggaaatgacagtttctgttgaattataattctccggtttaagggtctccttcccctggtgtctgatggtgagaggtctgaagagcatttgtcagagtacattaggcattctcaacctacttcatgctttacgagagctgagaaatcagacgcaccggcctttattattatatatgctacatctgttgagtatttttaaaataccaataagaggacttgtttatttcataaaccacttcttccctctctttcaaagaaaatacattattaccatacttttacattagtctgagaatttttgctaaatatgattaagtattccaaaatataatggcgtcattattcttgacttttttagagaatatacatcttaagactgtattagttctcagagcaaggcatcatctactcccctgcacctgagagtctggccccagattccagatgtgcggacagcccatgaccgaggtgcacacagtgccctcttgaataggaaggtcagccagtgaggcggcagcataacttgcaggatggacttatatcttaccatctcttcctgctaccaaaataaaaaaataaattgaaagacaagacccaccagtctagttttgtagacctgtgaaatgtgtctttatttcttggcattagaagaaagatatttttaatccatatcgtggttttagagttgaagtgaattgatacccaattttccatcttagatctcctttatcaaaaaaaaaagcattttttttctcctaacgtgtctcccaaaatgtaaatactataggcaaaaagagtaccctgtaaaattctcacactggagcacctcttcaaaagtcacagataactcaatgaggaagtgctggtactgcactcacaggacatgagacctatgaagctttcgtgttttgaaagcatccttctgtgtgagggggactgcctcccttagtaaagtaaacctctcagaacttctttttaaaataaaaacagacaagatgcagttactaagctgcaagttttcattggcaaacctagctgaatccgttttaaaatacttagcactcggacacaattctcaaactcaggaagaaggaacagggttggtttgggtttactataaaggttgcctcacataaacaactgactccttttagcgttttttttctttttgtaaaaactttacacaaaatagggttttaaattctttttgcttgttttggacttggtgtatttttgtcaagtttatattgattggcaacgcagagactccttgagggcagggactgtggcctttgattcacttatgctacagtctagtatcactacagtgctgagtaaaagacacagcccctgccctcttggagatcatattgtttatatttgaaatctcagttgctaagagtatgtatgtgtgagtaagaaagacgtgaagtcctatgggcagctgggtatatggagaattacgtgtgtcctgtctttaaaacgtcagcctctattaaggggtacagaacaccccaagatcactaaaacttggaatgtgttggaggcagaaagtatctctctcattgcctagtgttgttgtttttttgttttttgttttttgttttttttactgacctggaattcttttaattgtaataaatatcttctgtcacaaataaatgccacaaataaatgaaattgccattcctaagctgagcacctgtctgtgaaggaccttggtgtcctgactggacagagcattcatagctccaagagaatcatgacaagatatgcaaagcagggataataaggagaaagcccttccctttcgagaagcccttccctttcacagcccttccctgcgattctgcagtgaaaagtgatgcccagagatccacacacagaacccttctaaccagccaggtcaagacttatcatcttatctcctctggcaggtcccctgtaatcaaaagagaggaagtgtctatctaaacaagacccttttgggtccttagattcatggcaaaaatcatcatggcccccatcagaaaagaaaatcagcaataaaccaagccaagcaactaaaatgtataatgtggacctgactcatgttgggaggcagaattcagacactcacagatcaatcttgcaagttttctcttctttaagttgagctgctcaactttatgaactgtgaaatttacttacattctttcaacccacatatatcattgcagtttatgaagttgcagtgaactgcccattcagctaaattgcagtgtttattcttgtctcatgtcgaaatacaacaatcttatgggaaatattatgacagtccgttccaactgttctcagacacatgcataaacagtctctgctcacattccacagccacctgcatgttatccatacagctccctgagaagtccagggatgggaggtggggtgtggaaggatggagggtccttcattttctaaacactttgtataagtcactactcatcgtgcctagcaagtataagattaacattttgaataacaaactggaaaacaaataatccttcaaagaacctagcgaactgttcaaaggaaattttaatttcagtctaccagaaaagttaaatctgttgttggacgtagggggctttcagaaacatgcctcttatatcaatttccactatctttcaagttacctaaaggcaccaggctgcttgagcaagaagaataaaaggcctagagtgcaaattatgtgaagtagagtttttagattgtgggattgtaataatacgggattctcatggttacatcatgttaaatcacactgttcagtctttaaaacttggtgttttaaaatttgtctcattgtgatagccagaaacaaggaataaacgtgatttcagtttaaactatatacaaatatcttctgtaattttgctgctctaatttttaggctataaattttgtaatagagcttatcagatcgcaaatttcctttgtttacaatctcatgtagtagggctcagataatttcttagctataaaccttttctcccactctcatattgtttcatttaaaatatttaagctaagcctaaaaattgaaatcagttaagaatttggagagtttatcttaaatggaaatggtgtattcttttcaaagaattttgtaaccatctttacagtttctttgcttggaaaacttgggttgttaactaccagttaacaatggcattactttccaaaacgttatctaatgggcccaatgtgtacctcaagataaacacagtatgttatgtctaaaaatttccttgtctgttgatttaaatggttctgaaatgtctgtaataaagaaattttcaaagttgcaaaaaaaaaaaaaa

SEQ ID NO: 791 - DNA, 973 bp, Human
gacgcgtgggcggtgaaggaggagtgccgcctgctcaatgcccctccagtgcctcctcggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcct

SEQ ID NO: 792 - DNA, 2558 bp, Human
ccgccctgctcgtgataaggcacaagcaagggctgccctgaaggaagctccaaagagaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctcaaaaaaaaaaaaaaaaaa

SEQ ID NO: 793 - DNA, 4336 bp, Human
agttcgccctgccggaaagcagcacgccgccgcggcattttacgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgaaccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttg

SEQ ID NO: 794 - DNA, 3097 bp, Human
atcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccaaaaaaaaaaaa

SEQ ID NO: 795 - DNA, 1863 bp, Human
agtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtgaaaaaaaaaaaaaaaaaaaaaaaaaaa

SEQ ID NO: 796 - DNA, 4139 bp, Human
aagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaaaaaaaaaaa

SEQ ID NO: 797 - DNA, 844 bp, Human
ccagcggctgcggcggcggagctcctccgaggtccgggtcaccagtctctgctcttcccagcctctccggcgcgctccaagggcttcccgtcgggaccatgcgcggccgtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaaaaaaaaaaaaaaaaa

SEQ ID NO: 798 - DNA, 7169 bp, Human
gggaggagatccgctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaaaaaaaaaaaaaaaaa

SEQ ID NO: 799 - DNA, 1465 bp, Human
gcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattgaaaaaaaaaaaaaa

SEQ ID NO: 800 - DNA, 8436 bp, Human
aagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaaaaaaaaaaa

SEQ ID NO: 801 - DNA, 6427 bp, Human
atagaggctgggggtggggggggaggtcaagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgaaaaaaaaaaaaaaaaaaaaaaaaaaaaaaaaaaaaaaaaaaaaaaaaaaaaa

SEQ ID NO: 802 - DNA, 2257 bp, Human
cttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgctt

SEQ ID NO: 803 - DNA, 3366 bp, Human
gcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggccttaaaa

SEQ ID NO: 804 - DNA, 2879 bp, Human
gattggtgggttcatgtttcccgtcccccgcccgcgggaagtgggggtgaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaatactcaaaaaaaaaaaaaaaaaa

SEQ ID NO: 805 - DNA, 2551 bp, Human
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttaaaaaaaaaaaaaaaaaaaaaaaaaaaaaaa

SEQ ID NO: 806 - DNA, 914 bp, Human
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcaaaaaaaaaaaaaaaaaa

SEQ ID NO: 807 - DNA, 2138 bp, Human
caatgggctgggccgcgcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgcaaaaaaaaaaaaaaaaaa

SEQ ID NO: 808 - DNA, 2268 bp, Human
gctgcaggaagcagcaggagacgcccggcagccgggacggtcggggacgcctgaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgcaaaaaaaaaaaaa

SEQ ID NO: 809 - DNA, 1955 bp, Human
acgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgctaaaaaaaaaaaaaaaaaaaaa

SEQ ID NO: 810 - DNA, 1480 bp, Human
ggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcctaaaaaaaaaaaaaaaaaaaaaaaaaaaaaaaaaaaaaa

SEQ ID NO: 811 - DNA, 15592 bp, Human
gaaatcttttaggcctttagatgttgttctggaaaaactttagtaatggatcaaaggaagaatgagagtattgttcctagtataactcaattagaagattttcttacagaacacaattccaatgttgtttggctccttgttgctaccattttgtcctgtggatggattatttacctcacatattataattcccggaatgttggtcttattttaacactagttcttaacagattatacaagcatggctatatccatattggttccttctctttctctgttctttctggaaaagtcatggttcgtgaaatctattacattacagaagacatgtctattaggattcaagatggattcatcatttttcggtggtggaaaatgtataacccaaaacagaagcaacatgatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaagtctgtaaaaaaaaaaaaaaaaaa

SEQ ID NO: 812 - DNA, 1901 bp, Human
acaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaatgtcaaaaaaaaaa

SEQ ID NO: 813 - DNA, 6644 bp, Human
gtgaccccaggccctggtcactccatgctttggagggtgcttttgtcaaagaggcctcctttccctcacccagagctggatttccaagaggctcccatacctagctgccctggcagactcccagggaggaaaaacagcgtggccttggcagctgccccgaggaaggagcccacaggtgacagggagaagccattgccattccctgtcctggcccccttcagcaaccctgaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctctttttttttttttttcccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaaaaaaaaaaaaaaaaaaaaaaaaaaaaaaaaaaaaaaaaaaaaaaaaaaaaa

SEQ ID NO: 814 - DNA, 3420 bp, Human
ggagcgggggataaggttaccacgcccgcggtggccggggacactctgagtttcgcgtgtggcttttagggacgtttatatttgaatttccctgaaccgccgagtgtgggcggtggcgcagatccgtcccggaaacctccgggctccttcccgcctttctcaggcccggcccctccaaggggtccccgcggggcggcgggagggccctgggcccagagccgcgcgggtgggcagtcccaggcgtccttccttacagccctgagcctggtccgggaaccgcccagccgggagggccgagctgacggttgcccaagggccagattttaaatttacaggcccggcccccgaaccgccgaagcgcgctgcctgctccccattggcccatggtagtcacgtggaggcgccggggcgtgccggccatgttggggagtgcggcgccgcggcccgcgccacctccgccccccgcggcttgcctccagcccgcccctcccggccctcctccccccgcccgccgctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattgaaaaaaaaaaaaaaaaaa

SEQ ID NO: 815 - DNA, 3994 bp, Human
gcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgcagccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaaaaaaaaaaaaaaaaaaaaaaaaaaaaaaaaaaaaaaaaaaaaaaaaaa

SEQ ID NO: 816 - DNA, 2080 bp, Human
ggagggcagtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttcaaaaaaaaaaaaaaaaaaaa

SEQ ID NO: 817 - DNA, 3454 bp, Human
gcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctccgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgcc

SEQ ID NO: 818 - DNA, 4213 bp, Human
ttcaccggaaaacacagtagctgtagctgcacatagacgcttcctctttctgtttccccctcatccccctccctagacctctctgggctttgacgtcatgtgtgctcctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtagaaagaacatatgtgatacttatgtaaagtgtggggcgagtgggtaacagttttcaggcacaaaatggtttggccttctgaaggcaggtgtgaataaaagctgagagtcttttctgtgacagtaaagagtaggagagactggagggtagtgtgtggtgtggactaagactgaaaggaggttattacccagatactaggagacactggtgtccctgttttagagatttggctctatacccatttgtcatttctcaattactggtcacaacaagaggccactggagaaagtggcaggtggtgaagcaaggttattgtgtgtgcttttgatgataagaatctctctctggaactgagcagaattgcctccatgtgaattccttcaacaaaaaaatgagcctgcctagactactttcagattgtggattgtgttttccatgtgtgggctgcttccctgattcatactctgccaaagttttattttgagaaataatattactttcctcttctgaaataaaataataataataataatgaaacccccaaaccacagtgtgagtctcaggttagcatttgaaaacatctccagagacattgttattcctcaggagtttccctgactccttaatgtggctgatgtttcatgtttatttatttattttaataagtatgagcaatcgaagggctgatcatctgagttttgtactgcagtagatgtaagagcaataactctgcccataaatttactgctgccaaatagttttagcaatatgagtttgtcttaaaagccatgaagcattaatgtcaatgtttagcaaaatctccagaatttagcttaaattaaattaaatgaaagtgctttcctgagcacttaaggaggcactgtgaaacatcttggttatgtacaaggcaataccaaggtgatctcagcaataatcaggcttcccttcttattcacttcgaagtatccatcacagttatttgcactctgaccatgttggtgctcactagagtggtgatatttcacctgaagaagtgaaagacaggaagtggatggttgatgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaaataaatagaagaacattcctttgtgcagcttgtcccctggaataaaaatggcccattttctcta

SEQ ID NO: 819 - DNA, 2640 bp, Human
ctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtaaaaaaaaaaaaaaaaaa

SEQ ID NO: 820 - DNA, 5544 bp, Human
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 821 - DNA, 5756 bp, Human
taggcaggcggctgagccggcggcgggtggcctgcccaacgtgtgctgggtgggagaaggcgaggcgtcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtagagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatcaaaaaaaaaaaaaaaaaa

SEQ ID NO: 822 - DNA, 2559 bp, Human
gcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgg

SEQ ID NO: 823 - DNA, 2551 bp, Human
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaaaaaaaaaaaaaaaaaa

SEQ ID NO: 824 - DNA, 7450 bp, Human
cgccggggcgagttcctgcagggtggacccggcgatcaggtctccgcggtgccactttgggcgcgggcgggaagccgggacgctccgcacctgcagcgaccttgggctccgcggagcgggcgcgggcacctgtggctgcgtcctatggcgcacgtggaggcggaggctccggggagccgccggggccgcctgtgagccggagagcggaggaggcaccggcgcgcacgatgtcgttccttgaagaggcgagggcagcggggcgcgcggtggtcctggcgttggtgctgctgctgctccccgccgtgcccgtgggcgccagcgttccgccgcggcccctgctcccgctgcagcccggcatgccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggagaaccgtctactacatgggctacaggcaggtgtataccacggaggcccggaccgtgctcaggtgctgccgagggtggatgcagcagcccgacgaggagggctgcctctcggctgaatgcagcgccagcctctgttttcacggtggccgttgtgtgccaggctcagcccagccgtgtcactgtccccccggcttccagggaccccgctgtcagtatgatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccggattgagatggaaatcgtgaacagctgtgaggccaacaacggcggctgctcccatggctgcagccacaccagtgctgggcccctgtgcacatgtccccgcggctacgagctggacacagatcagaggacctgcatcgatgtcgacgactgtgcagacagcccgtgctgccagcaggtgtgcaccaacaaccctggcgggtacgagtgcggctgctacgccggctaccggctcagtgccgatggctgcggctgtgaggatgtggatgagtgcgcctccagccgtggcggctgcgagcaccactgcaccaacctggccggctccttccagtgctcctgcgaggccggctaccggctgcacgaggaccgtaggggctgcagccccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagacttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgtttgctgtgttacgtggactctgtgtgggctcctccctggggcccggccagcataacggtgcacccagggacctcccagtgcacccggggccctttgcaggggtgggggtgccacacaagtgaagaagttgggactcatctcagttcccagtgctattgaggagaacgctggggctgcattcattaccgctgagacccagagactggctgttcccagagaatggcccagggggaggagggctggtgtggaggggcaacctggactgaggccgaactcccttgggctcaccccacccacccctacctgagcatcagcagtggggggagggcagcatcgcaggggcagggactccctgggtgaggacagaccagccctcccgagcacctggcactcatgggctgaggctgacttctcctggaagaagggcccagagtggaaggaagaggcagagggtagaggtggtggctgggggctcctctgcagagtggggtggccaatggagagggctgcactcacaccgcaacataggactctctctcccttaagaaggcccccttagggtctgggctgccgcccccatcaccctaaaaccagccaaggtagctgaggccccagggcagacaatttcaccagcaggaggaggaggagtccagtgagcttggttgctcacagacagcaagggagctgtcacagaggaagctgatgaatggaccgctgtggggagactttaaagtagaacagtgataagggagggcaggatggtggggatgcagaagcagcagccagagagagacggactggggtgcagacggagtgtggaaaacgcataccttgaaatgaagcatccagcagatggggtgagtggatacagctcaggagattctcccaggaatagcagggaggcgtaaagagagacaacgtacagagatagatgaatggaaatgggtaagggaggtgttcattcacatccatctaactgcaaaatacaaaagtaagaagtcattgacatgaagcaacgacgaccaagacgttctcagatctaaaggtgaatgatctcagtcagcctggaaatgcacaaggtggaaaaataacataaaaaagccataagaccttgaagaacatcaatgtcaaagataaattctaaagtcccagagaaaaaagaatgggaatcaaattgacctcagactatacgtgagaaacacggagagccagaaaactgtgatgttccatcctcagagtttgaaggaaatatttgaaggctgaattttacatccagctaaactatcaaaggcatgcaaagtccatgttattcttaggccttcaaggcctcggccatttttctacagaaaagcctgattttaaaatgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatcccatgtatcaaaacatcactgtgtatccgatgaatatctacaattattgtcaattaaaaacatcattaaaaacagactagactgcattaaaaataaaaaaaaaaaa

SEQ ID NO: 825 - DNA, 7500 bp, Human
agctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgcaaaaaaaaaaaaaaaaatccgaaga

SEQ ID NO: 826 - DNA, 1101 bp, Human
atgtgcggtgaggctcgcggccggagtgcggcgctgggcggaagctaccatggcggccgagcgaaagacaaggttgtccaagaatctactgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatatttattatgtcaagccaattcgtacatacaatttggaatcaaatgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 827 - DNA, 1344 bp, Human
agagagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactagagtttgtaaaaaa

SEQ ID NO: 828 - DNA, 4119 bp, Human
cgcggggagcggcggcggcggcggcggcggcggtggcggaggcggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcaggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctcaaaaaaaaaaaaaaaaaa

SEQ ID NO: 829 - DNA, 2212 bp, Human
gctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcggggatgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaaaaaaaaaaaaaaaaaaaa

SEQ ID NO: 830 - DNA, 741 bp, Human
gcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgaaaaaaaaaaaaaaaaaaaaaaaaaaaaaaaaaaaaaaaaaaaa

SEQ ID NO: 831 - DNA, 4519 bp, Human
cgcggcgatccgagcatgagcctggagcgcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactacgggagctcagtgtagctgaagatgaagatgaggaggaggaggcggaggaggcggcagccacagcggagagcgaagccctggaggccggcgaggtggagctctcagagggcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaaaaaa

SEQ ID NO: 832 - DNA, 5252 bp, Human
aggcggggccaagatggcggcgcagcgcgcggcgggggcgacgggcggcgggggccggggggcggtgggacgttgaccccgccccctgctgctgctagtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtctgcaaaaaaaaaaaaaa

SEQ ID NO: 833 - DNA, 2939 bp, Human
cacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaaaaaaaaaaaaaaaaaaaaaaa

SEQ ID NO: 834 - DNA, 2939 bp, Human; identical to SEQ ID NO: 833

SEQ ID NO: 835 - DNA, 5559 bp, Human
ctatgaccaaatgtatggggctttttcccacacaccaagcaagcaagcagttctgcagagggcacacagtgtcctctaactcagtttgattctgatactatctacctggaaacagcatcagatcccacagtttgagggctcaatcccacaagactttcccccatttcagacaccaatcacaagtaatagtttgtcacctacacctctgaccaagtggctataaattggtgttcccactaccctctccttggactcaactgatttgctagagcaactgacagaactcaggaaaacacctacatttactggtttattttaaaggatattataagggataccaatgaacaccagatggaagagatgcatagggcagggtctgtgggaagggtggcagagctcccatgccctcccaacgtgcaccaccctccaggaacctctaaatgttcagctgcccggcagctccccacacccagtccttttgagtttttaatggaggctttattatgtaggcatgattgattacatcattggccactggtgattagtttaacttttagcccctcatctcctggaggttggggcgtgggactgaaaaatcctatcctctaatcataccttggtctgtcctgtgagcagcccccatcccgaagcttccaggggttccccaaccactaatcatctaataagcatacaaaaaacactcttaccactctggagatctcaagggtttggggagctatatgtcaggaaacagggatgaagaccaaacatgtatttcactgtatcacacctgttctcacccctccccagatcttctctcaattaatatgagacaaaaaaatgagtctgacttcttgaccaaaatatcagttctgtccttagcagctttatggaggacagatttagtttaaattccttaggcattatgcccctgtggctccactcaatcagaaatagggtcaacggcaaggtcagggcctccaatctgggcaagagggaggcagccacggtatccacaagtgtaattctctgagtgctggttgctgggaggggcacaccctgggccagcaagtcacttggccaagggtggccaactgtgaggtagcactgccctttactccctaaaaaaatgtgaatctctttggagcaaactcctcttcagaaatttgagcacttgttttctgagcaagggaatcagctaatgcttttgactccccatccatcttcctgcatcctcgtcccacctctcctgcccccactcacctggctctgtctttacccacaccatggttttggtacaagaacacccttttccccataagctacattggtccaggccataaaaattcattagttccctttcttcaggggccttctgaaatgctccctggagaactctttattcacttctttgcacaagaatcacatatgtgtgaacactggtattggccttctaactcagtttcttcaaaccagggtcctggtctggttgcccctgtctcctcccactgagttttatctccacataagtattgctcaccaagaacagagctgttgacaccactgggcctcaagcatgctgaatgcattgctgccaactgctctgccttaagaaggttggaaactgatgagggtgccacaaattgttcacctcagcccttctgggctggttggaggaggccctctcatgaatcagtcagcaaatgtttgacccctaccaggtggtcctggtaatatgtggtatgaatcatggtcctagatgtctgccatagcaaataaaaaaggaagacagggaaagaagctgtcgcctacagagtggcttgatgacagctgcctcactaatttaaaaagccatgtgtagtgcttcctatttctcactatgtttgggtgagtgggagagggagaaagattatatgggcttcgttgtgacactgttcttagccagtgggtcaatagatgagttttggttttgttttttagaagacaggatgagaagagagtgcccccttccacctccaacatggcatgccatgctaggtgctgaaggagttctctaagcagggatggagcaccgtgcgtgtgtgtgtgtatatgtgcacgtgtgtgtgtacgtgtgtgtgtgtggcaggtctagagggtcgatggctctttcctgcctcttgcccttggtatgggtaccttagtgatgcatcatggccctcccttaggacacacagcttcgcagtgccagtgaacccactccttttggctcctcctctggaatgataagcccagatgcccatgctgcccgtgaagggcttcttcttgaactgaatgtggagggcatctctggtcccggccatctgccagtgactctcatgtgcattcatgtccctctcttctctctgtcctgtcttctctgccgctgcctcttctctgcaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaagaaaaaagagaaagaaaaaaaagaatgaatgcaagctgatagctgagactgtgagactgtttttgtccactcttctgaatcactgccacttgggtcagggaccacagccattgccacccttggcccatctctctgcgtgcgtgccttgagcacacatataaaaagtgccatgtgcaattgtcttatcttttatgatctaggctttgcctagggatcactactccttaacgggctggctggggcaatgaggaaaagctcctttgctcctgtaaggccataagtggctgttaacagattttcaaatgcctgaagagattgctgagacctgctagagtcatatgttcggggaattaagtctttatcctagacaacaaggtacagatgcaaactgcagtgttattggagggtcaatcggcaaggatatgattatcccaaaatggagttcatcgaccctagctttcctttagattatatataaataaaagtgcagtcctcttctaatggccacagttggttttcttgtagcccagaaagtccaaattaaaggaaataaattcagttttatgttagccttccttggtgcatcagggtgtcagtggaaataggatcaggtggtgtgtgtgtgtgtgttttgtgtgtgtgtgtacacatgtgtttatatatacatgtgtgagggaaagtgtgtacatatatgtaggattgtaaccagacggaaaagaacgaggatctccagggtgtttgaatcagcaacagatttgtgttttctaacatgcatttagttggagaggcatggttctgtttgttttgttttgatctaatttgccattggaaataggtacagttacacagagaaggaagaaccaggaaagtgagatccatgaaactaaatgagcagctgtcagaatccagtgtggctgagcctacctagcttatgaaatctaacccagggttccctgagtccaagaccacttagattattaagattttgaacgtccagaggagtgaaaagtctgttttctgacgtaagccggagctgaggataaagccagaggccagtggattaggtgtatggaatgtggatggagagggcttgtgtgggatgtggccagggagtgggtgaggaaggccgcttctaaatggcctgtaaaaacttgagattggatagacgaaaggaaatggagaaattaaagaattggagaaactagttatctgtgttgctgactttgggacccatccaagactcctgcccttggggtgttccatggtggtttcttcctgcctgggcgccaccctttccccagttcaggccctccctggaggactagtttgtgtattggtatcctccccagtggacccaaaccagcgcatacttggtgtgtggagatgggagacaaaggacagatctaggagccttgaaggatcaccagccaccgaccctccatcagggccaactgggcaggaaagggaacattgcagacctgatttcccgacgatgtcaccctgtcctccctccttgcttcttgctctgctaactcaactctgccttcctctttttcattcttctactctgcc

SEQ ID NO: 836 - DNA, 2212 bp, Human
gccgcgagggcggggcccgcagttcggttgcgctgcggagcgcagctgtgagggagtcgctgtgatccggggccccggaacccgagctggagctgaagcgcaggctgcggggcgcggagtcgggaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaaaaaaaaaaaaa

SEQ ID NO: 837 - DNA, 4001 bp, Human
aggcatcagcaatctatcagggaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctctaaaaaaaaaaaaaaaaa

SEQ ID NO: 838 - DNA, 3959 bp, Human
ttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 839 - DNA, 4161 bp, Human
gcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcgtgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttct

SEQ ID NO: 840 - DNA, 2474 bp, Human
gacatcaccggccagccgggtggagtgagcggcgctgggctcgggctccggctccgcgggcggaagaggcggcggcggcggcagaagcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaaaaaaa

SEQ ID NO: 841 - DNA, 4717 bp, Human
attatgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgcccaaaaaaaaa

SEQ ID NO: 842 - DNA, 4475 bp, Human
cgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttc

SEQ ID NO: 843 - DNA, 2021 bp, Human
gcagggatttggcaacctcagagccgcgaggaggaggcggagtcgcggagagtttgagtatttccgtccaatcaaaaggagactgtaagaggaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaactccttctgcaaaaaaa

SEQ ID NO: 844 - DNA, 2369 bp, Human
cctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaattggaaaaaaaaaaaa

SEQ ID NO: 845 - DNA, 6356 bp, Human
ccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctgaaaaaaaaaaaaaaaaaaaaa

SEQ ID NO: 846 - DNA, 1994 bp, Human
tggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccagctgaacaatttcagtcatttgaagcctccgtcccttcttccattctcagccagaagcataaacagaaaagaaagatttaagaggattcacactcaacaggttttaggataatttaaatatcaaaaattgattgttatacttaacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttttgcagtttcttgcagtttcaaaaattaaagacctacatcacagggttaatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaaaaaaaaaaaaaaaaaa

SEQ ID NO: 847 - DNA, 1045 bp, Human
actatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatataaaaaaaaaaaaaaaaaa

SEQ ID NO: 848 - DNA, 4118 bp, Human
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaaaaaaaaaaaaaaaaaaaaaa

SEQ ID NO: 849 - DNA, 3711 bp, Human
atcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaaaaaaa

SEQ ID NO: 850 - DNA, 1558 bp, Human
gagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaaaaaaaa

SEQ ID NO: 851 - DNA, 2166 bp, Human
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaaaaaaaaaaaaaaaa

SEQ ID NO: 852 - DNA, 2059 bp, Human
agtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatct

SEQ ID NO: 853 - DNA, 1979 bp, Human
ggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaagaaaaaaaaaaaaaaaaaaaaaaa

SEQ ID NO: 854 - DNA, 1665 bp, Human
gtgcgtgccgtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaaaaaaaaaaaaaaaaa

SEQ ID NO: 855 - DNA, 1888 bp, Human
ctacgatgacgtcagcgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatctctaaaaaa

SEQ ID NO: 856 - DNA, 5639 bp, Human
cttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttaaaaaaaaa

SEQ ID NO: 857 - DNA, 8689 bp, Human
ctcctctcttttggaaaccggagaggtggagggagggcaacaccgctgcaaaggagaggcccgccaagtctgcccgcctgcaaagtgttgctttgacacattcttattatggaagttaagtaaaaatatagacatattaaaaaataactccggacgtggagctgctacggagaaggaaaccgggggaaagaaaaccagtaggcaggccaatggtttttcggcagcgcgctggcaagtttgtggaacactttctaggaattaggtcttttcctcccccttcatcatcttgacttctgaaggaagaacttggctttggattgcagtggagcctaaggagagagggttagacacactcgaataatccctctggctgggctgaatttgtgggaatttaggaagccagagtgctggaaatacagcagcctttgaagtaccctctgttaatttggatggatctcagtgtgccccgttcgagacctctccaccaaccccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaaa

SEQ ID NO: 858 - DNA, 4554 bp, Human
gagggcacgaagaggcaccgaccgtacccaggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacgggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacgtgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgccggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcgggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagcccaggg

SEQ ID NO: 859 - DNA, 719 bp, Human
agtctcttttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttc

SEQ ID NO: 860 - DNA, 579 bp, Human
tctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactctagaaaaaaaaaaaaaaaaa

SEQ ID NO: 861 - DNA, 1580 bp, Human
ccttgtcctgcccagatcttgtcccttctagtactggccttccccattcctgggggcccccgcccctccgacccccgccgaccggcgctggactacaactcccggcgtgccgcgcgcgtccggccggctgcaccggggctttgcgcgtggcggccgccgagctccgcgcggggcaaacctcccggcgcggccatgcggggagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaatgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtttaaaaaaaaaaaaaa

SEQ ID NO: 862 - DNA, 2928 bp, Human
tgtcccgtttccggacccgtctctatggtgtaggagaaacccggcccccagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 863 - DNA, 3217 bp, Human
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaaaaaaaaaaaaaaaaa

SEQ ID NO: 864 - DNA, 2517 bp, Human
aggcaagtgtcaggccgatgtgtcgcccgcgaggggccggggtcggggccgccggggccatgcgcgcgggctgggcagggggccggcggggcgcagagcggagccgcctcggagcctgagccgcccggggccggggccggggagccgcgcggggccggccggccggggggaggggagcgatgcggcgccggcgggcggcagtggccgcgggtttctgcgcctccttcctgctgggctccgtcctcaacgtgctcttcgctccgggctcggagcctccgaggccaggccagtcccctgagccttcgccggccccgggtccgggccgtcgcgggggccgcggggagctggcccggcagatccgggcgcgctacgaggaggtgcagcgctattcccgcgggggccccgggcccggggcgggccggccggagcggcggcgcctgatggacctggctccgggcgggcccggcctgccgcgcccccggcccccttgggcccggcccctgtccgacggcgccccaggctggcccccggctcccggcccaggctcccccggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaactcttccctaaaaaaaaaaaaaaaaaa

SEQ ID NO: 865 - DNA, 2358 bp, Human
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctctaaaaaaaaaaaaaaaaaaaaaaaaaaaaaaaaaaaaaaaaaaa

SEQ ID NO: 866 - DNA, 3569 bp, Human
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 867 - DNA, 1038 bp, Human
aagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaaaaaaaaaaaaaaa

SEQ ID NO: 868 - DNA, 8475 bp, Human
gttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggc

SEQ ID NO: 869 - DNA, 5308 bp, Human
ggcctgctccgggcgcgtcaggcagggggtggggagcaggggccgggcgggcgctcggctcccagccgcgctccctcgggccactagcgctcccgcgcgcgcccggccgccttcatgtgaagcgccggccctccgccccttccctccccttccttccctccctccctccctgtcccctcctcctcctcctcctcctccggcgcccgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaaaaaaaaaaaaaaaaa

SEQ ID NO: 870 - DNA, 2246 bp, Human
gccgctgcgtccccactatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctgagcctggaaaaaaaaaaaaaaaaaaaaaaaaaaaaaaa

SEQ ID NO: 871 - DNA, 27439 bp, Human
cggccgccggccgcagcgggctgagattgttgtcctctgtcaccagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagtccatgcacagaggatcaccgattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaaaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaatagtt

SEQ ID NO: 872 - DNA, 2310 bp, Human
acttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaataattgttttcccagttattcaaagcagctttctatatgtagagatgcaaattattaagttgtttccaatacaataaataaaagcatctgtttttcactttaaaaaaaaaaaaaaaa

SEQ ID NO: 873 - DNA, 1448 bp, Human
gcctctccagctgcgacacagatggcgcgcgggctcttgggttctgtagttttctcgcgatccaaaaggctccgtgcccaaagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaaaaaaaaaaaaaaaaaaaaaaaaaaaaaaaaaaaaaaaaaaa

SEQ ID NO: 874 - DNA, 3877 bp, Human
gaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccaccaccaacatcggtaactccctgtattctcatttttctgtttaatctccacaacagccctatgagggtggctccctttgttgtttgcattttaaggaactgggagtgaggctcagagaagttgagggacctgtcccagcatcacatggctgatgacaagtggacagacctggtgtttgagcacaggccattcacattctgacccgttgcctggtgctgccccgacactctcctctcctgggcttgggcattgccctctggctctgtgtggagcctttacgaggccacctgcctctctgagggatctaaacaactgggagggaggggaccgctccccctttctctgtgggggtggactaacacaattaaaatgaacatcctgcttaaaaaaaaaaaaaaaaa

SEQ ID NO: 875 - DNA, 2444 bp, Human
attactgacacaaacgctccctcagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaataaaaaagaaaaagc

SEQ ID NO: 876 - DNA, 1753 bp, Human
agacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctctgtcctctttggaatgtaacaataaaaataatttttgaaacatcc

SEQ ID NO: 877 - DNA, 5593 bp, Human
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccttaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccacactgggaagggggagggaggtagagaatgaggtttgagagagaaaatcccatcagggaaggccgggcccttgcttttgagcagcatccaggccttgttcatggcttcatgatcctgtccttcagcccttctttggggcttaattctggaatgtcctgcagagttcggcacaaggagatctcccctgtcgggggctctcccctgtatccagctctgtccctctgaaggctgaggacttgcagtctcacatctggacctccatttctgcacagaggccagtgtggatactgggagccagttgtgacaccaccatttactaaccactgctccatatgtgattctgttccaagtccttattgtgcatttcctcattttacctcctaacaaccttgtgaggcaggctatagtttatttattttacttatttactttgaaacagggtctcactctgtcactcaagctggagtgtgatggtgagatcatagctcactgcaaccttgaactcctggttcaggggatcctcctgtctcagcctcccaagtagttaggactataagcggctgcaccaccacgcccagctcatttttaaaaatggtgtttttttttgtagacagggtcttgctatgttgcccaggctggtctcgaacccctgggctcaagcaaacctcctgccttggcctcccgaagtgctcagattacaggcatgagccaccacgcccagcctaggtaggatataattttatagatgggaaaaggaggcttggaaggttaactaacttccctggagtcacaaagccagtaaggcatggctgtaggagttgaacccagtttgtcagattccaaagcccatgatgttctcttcttacctgttctttgacctgaggcaaagatcccaagaagtagcaagcaggcttaggagtgagtccttcaggtagagggtggactgcataagccctaagtccctccacttcctagattcttctctgtgagctgctttagggcaggctcaggatcacacaggtgtcttctttgacttcatagaacatgtgcttctaggctgctaccccaccctctgtcttcatcattagtaagcagcaccactaggtacctactcaagccaaaacttggattacaccctttctctcatgtctcctccccaatccaactgcaaagccctaccaagtctacctctaaagtattcagctgatttacttactcatgtctctgcatctccacagccatcaacactgtccacgtcacattgctctcatctgtctccatgtttcttttcctgctctcctacaatttgttctcccaagaagccaagagtcatcttttaaaagttaattcaccaacatttactacccagtctgctttgtccagcactgtatcctggtcaccctaaacagtgccccaaatattagacattgcttagtaaataagaaatgactgttggacatctatactggacttcccatccatatctacatcatcatagggccaatgctaaaactttctcccataaagtcctgactcatatatttctattttctagtcacatagacagaaaacctcaagagtttttagtactttcgcataaactcaatggtattaaatcatttaagatttcacttccacaaactttctcatatcatttccctcttttcaattatcactgcctacacttattaactgagtaatcatagcaatttcctaattggtccttctgtctatgttctgaagcatcaatctttctaaactgcagctaataaaaaacaaaacttctctgctgctgttttttgttgtttttcatagaacacctcagcctggcattcaaggctcttcgaagccttactttccacttcattcctacacatacccaaatagaactattcattgttctctaggcaagtttggtcccttttctcccatgtcttttcattcccagttactacagtgtctggcacataacggctcaataaatgtttgttgaatgccttcttgttgaaatccttctcacactaaaacagttcaccttaaacactactttcttcatgaaaatcttaacggccctcatccacaggtctttctccttccttttctagtccttatggcacttaaacctttcactgctgtgtatcatggccatgcgtaagtgtctcattcttctgtgagcctgtaagctggcagaaatgtttctttctttgcttttgtgtctgttgcagtatctcaaacaatctccccaccccacccccaacagcagatacctaataaatgtttgactttaaccactgtaa

SEQ ID NO: 878 - DNA, 2989 bp, Human
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaaaaaaaaa

SEQ ID NO: 879 - DNA, 10244 bp, Human
gcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcaaaaaaaaaaaaaaaaaa

SEQ ID NO: 880 - DNA, 2510 bp, Human
gcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaaaaaaaaaaaaaaaaaaaaaaaaa

SEQ ID NO: 881 - DNA, 1621 bp, Human
gcggcaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 882 - DNA, 3087 bp, Human
ccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaa

SEQ ID NO: 883 - DNA, 1877 bp, Human
ccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctaaaaaaaaaaa

SEQ ID NO: 884 - DNA, 2594 bp, Human
aggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaa

SEQ ID NO: 885 - DNA, 3223 bp, Human
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagt

SEQ ID NO: 886 - DNA, 2365 bp, Human
gcatttgttgggggcggagctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtg

SEQ ID NO: 887 - DNA, 1796 bp, Human
ggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaaaaaaaaaaaaaaaaaaaa

SEQ ID NO: 888 - DNA, 4659 bp, Human
tgtccctgcgtgtcggggtccgctcgtgcgcgcctctccggggtctgtgcgcgtggccctccgctcgcgccggagggcgtgggcgtggcctcggcgtgggtgtggccgctcggggaggggcctcccgggggcggggccggcctggtccgcgcggtgacgcgccctgcagccccgagcgagcgagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgagcctgcagtctcgctaggatgctttactcctccacaaacagcagccgccgacaggacagcttgtgaacgtctccgccttttggggtgtccggggagaggaggtggagctgtcccctcccagtgtcaggcctccttggtcctcatgtgcaccttttattcagagagcttgggcccccttcctttggagctgggcccagggcaggtggctggaatgcagaggacaagggggctggggcctctgcagggccattcccaccgcagtctctgccacggcccggagccctgggcccagggccacgcgggctccctctgctggcaaagccacaccctgcaccgcatggggtccactgcccctttccccacgtggactctgcgtgaccccaggaactgcagcattgaggtggtctcagtccctccctcaggtctggtgggcattgtgccaggggccaccttcgggacagctggccttggcaccgtctcccaagaacccagctctgtgcatcccgtggccccaccagaaacccaaggccacaccgcccaccagctgggtgtggtcaccattcatggagggccggctggggccaggctcaccacgcagagtttgccctccggtgtgatgatgcatgagacacagtaggcccccctgcctgtgtgtgcagggggtgtctgtgggggggccctgctggctggactttgggtttctcctgagctccccttagcccccaagtcaggccacggaggcctgagtaggacccatgggctgtgtgtgtcactgcaggtggcgtgctcacaactgcactgctggtcggcaggtggccagggttgcaggcccgggcctcgggccccacctcctctggaggggtaggatctccttcgtgcagcccctgccccctaccctgttctccggagtgttggcagatctgagcccacggtcacgtgagaggagatgcctcttgcacactgagcccaggcccagctcacggagcaccctgcaggtggcagcggggcaccaggggctcattcctggtggcctcagtggcttctgtggacgactcagactcacatgagaagctgggaggagctccagctctgcaatcccgagagggcagagcgggggccctggccacaaccctgctccccacatacccgtctggcagaggctctgcctcccctctgcccatctctgcacaccaaggctgagcacagcacaaggcctcacggagagggtgaaaaggcactgccgtctccatctcagtgccaaggaatgcccctttcagaagccctcgtctgagaagtgctgccccttatgtagccccaggcattttaaaatctttgaatctgcaccaagtctcagaacagctctggccccggagtgctccgtccaggccgctgtgaaccggctgtccccgcgtctcctccacctcccctgacacaatcctggccccgactcagtccacccagggtgcagtgcagaggctgatacccgccaggacttccttgccaagggcccggccacgtcacaaggccactgcacgcttttcgacatgcacctggaaatcgggaagggccatgctgcagttgcttctagttgagacgagaagagcgacaaggttgtgatccacgtggcaggtgttcagaaggctgggggcgggcagcgctggggagagccctgggtacttcgaggagaccccgaagggaggctgctcccacacctgcgccagtttccaccctctctgtgagcagggctgcggtcacctcccacatctgaagagaaccaacctgaggatttcacgctggctgcgtgccagaccagtccctgacaggttgtgcgaggcccttcgctggacagcccattgctggccactggacggagaggcagagggggctgaaattcgggcccatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtga

SEQ ID NO: 889 - DNA, 2833 bp, Human
ggcctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaaaaaaaaaaaaa

SEQ ID NO: 890 - DNA, 4795 bp, Human
agagcggagcctgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtcttgaaaaaaaaaaaaaaaaaa

SEQ ID NO: 891 - DNA, 2149 bp, Human
ggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaaaaaaaaaaaaaaaa

SEQ ID NO: 892 - DNA, 4248 bp, Human
cggaggctccccggtagggacggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcggtcatccagcacagtgagcggcccctgggcaccaccagaaaacatttgtgagtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagca

SEQ ID NO: 893 - DNA, 3861 bp, Human
tttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaatcgattctcataccttactaaacataagataattcatactggagaaaaatcttacaaatgtgaagaatgtggcaaaggctttaattggtcctcaacccttactaaacataaaagaattcatactggagagaaaccctacaaatgtgaagtgtgtggcaaagcctttaatgagtcctcaaaccttactacacataagatgattcatactggagagaaaccctacaaatgtgaagaatgtggcaaagcttttaaccggtccccacaacttactgcacataagataattcatactggagagaaaccttacaaatgtgaagaatgtggcaaagcttttagccagtcatcaatccttactacacataagagaattcacactggagagaaaccctacaaatgtgaagaatgtggcaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaaatggctcccagcattttgggaggctgaggtgggtggatcacaaggtcaagagatcgagaccatcctggccaacatggtgaaaccctgtctctactaaaaatacaaaaattatctgggtgtggtggcacgtgcctgtattcccatctactcgggaggcttaggcaggataatcacttgaacctgggaggtggaagttgcagtgagccaagattgtaccactgcactccagtttggcaacagagtgagactccgtctcaaaaaaaatttatactgtacaaaaaccccacaagtgtgaaaaacatggcaaagcctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggtaagataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacacagagagttcctgcttaataaaagcattataagtgcaattactgtcaaaagatctttcagaaaatataagcttttttagtgaagagtatttattttgaagttgaacatcacaaatataaaaagggttgtagtgcctttacttgtatcacagatctttttgtagacattttcttctagaggaaaactctgaagcagttgatcaaactttgttcaacatcagggaatttatattgaaaaattgtgcaaatataataaatttggaaaaacaatttttcaaaaactacagcttagaaatcaacagttatactagaatatattttttccagatgcagtaaaagtaaaatatttaatccataattaagtctatgcaaatatcagagaatttatggtagaaatatataaggtactgacacttcagatatactaaatcagagtgctaagtatagaaaatctgaaactaaagttggtagaaaagttatttgtatagaactttaagaggatcagaaggttttttgcagagttataattacattcaaagtatactttatttcttgaaaaatattacagattttttgaaaattgaataatgtcatcattcaactctgaaattatttcctgttgtttcttcattcctattggattcacatgtgaaagcatggggttaattgttgctacatcaaagagagagattcttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgcaaaaaaaaaaaaaaa

SEQ ID NO: 894 - DNA, 1839 bp, Human
ttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaaaaaaaaaaaaaa

SEQ ID NO: 895 - DNA, 2547 bp, Homo sapiens
tggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacggcaaaaaaaaaa

SEQ ID NO: 896 - DNA, 2128 bp, Homo sapiens
aatcctaggcggcgtcccctggccattacctcattccctggcctcgttctccccaatcccggcctctccaggggtgtggcagcagggctgttctcgcgacttttgctttacccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgtttgcacaagagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcc

SEQ ID NO: 897 - DNA, 3533 bp, Homo sapiens
aggggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaagcttaaaaaaaaaaaaaaaaaa

SEQ ID NO: 898 - DNA, 2149 bp, Homo sapiens
ggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaaaaaaaaaaaaa

SEQ ID NO: 899 - DNA, 1048 bp, Homo sapiens
ataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggaagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctgaaaaaaaaaaaaaaaaaaaaaa

SEQ ID NO: 900 - DNA, 1352 bp, Homo sapiens
cgtgaagtgggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 901 - DNA, 3019 bp, Homo sapiens
cccagccctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaattttggccaaaaaa

SEQ ID NO: 902 - DNA, 8056 bp, Homo sapiens
cgtggggatcccggggcagccgagggcccctgactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggcaaaaaaaaaaaaaaaaaa

SEQ ID NO: 903 - DNA, 965 bp, Homo sapiens
acccgcgcagggtgtgctagcgcgctcagccctctccggccggcttagtctagttcccgggcctcgctcggttccagaactttccagaaaatgccgcgctccctacggctcaagggtcaaatcgcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgagtggttaatctttaaaaaaaaaaaaa

SEQ ID NO: 904 - DNA, 1503 bp, Homo sapiens
atggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtga

SEQ ID NO: 905 - DNA, 1545 bp, Homo sapiens
tttccgcgagcgccggcactgcccgctccgagcccgtgtctgtcgggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaataaaaaaaaaaaaaaaaaaaaa

SEQ ID NO: 906 - DNA, 674 bp, Homo sapiens
atctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaaaaaaa

SEQ ID NO: 907 - DNA, 1646 bp, Homo sapiens
ggcggggccaggagagaaagctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaatcaaaaaaaaaaaaaaaaaa

SEQ ID NO: 908 - DNA, 1231 bp, Homo sapiens
agtacctgacattccaggcgcgagccacggcgccggctcctgttggttttagtatctgtcttgttccactagaatctcaaccccacaaggacaagaatttttatctgttttgttcactgctgttttttcagcatttatagcagctccaggcgcgtagcagagaatcattaaatatttatagaaagattaaatacgctcttccggaagcaccgacaaacaagattaaatgagcttggattgaacctcgtagcggcccgtagtactcctccttcccgccatcctatagatgaaaggaagaaaaggaaaagccccgcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaagtgtgttccctttttcctcctctctgtgttctctgtgtattataaaagaaatgaaacattccaaaaaaaaaaaaaaa

SEQ ID NO: 909 - DNA, 1426 bp, Homo sapiens
gggattggctactttaagttcagagtacgcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaa

SEQ ID NO: 910 - DNA, 5066 bp, Homo sapiens
gtgcgcccctccgaacgtccccgggagcccagccagagcgagcgccggggccgggcgcgcaggagtgaaaaggaggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagtggacactcttgggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaagtcctgtatttcaaaaaaaaaaaaaa

SEQ ID NO: 911 - DNA, 1828 bp, Homo sapiens
gatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtggaaaa

SEQ ID NO: 912 - DNA, 2737 bp, Homo sapiens
tgacgaaggggcccgaccgcgccgcgtttcgggagcggacgtccgagccacggccgaggcccgattagtccgtccggcaccgctcgggcactttcggaagggaagaggtggagaaccgacgttcgggagcattcggcctcggggacattcggctcgtctcggctcggcctcgggctgactcggcttccgccggcggcgggaacgggcgaaacccgcggcactaagctctctctgagaggcagaattgcgccggccgccggcgagaatctgcctagagccgtccagccctgtcggccggggacgacagccgcctcagcctgtcaggacagtgaggagagcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtctccctgccaaaaaaaaaaaaaaaaaaaaa

SEQ ID NO: 913 - DNA, 1504 bp, Homo sapiens
ggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcgacagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttgaaaaaaaaaaaaaaa

SEQ ID NO: 914 - DNA, 3668 bp, Homo sapiens
aggctggaaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtgaaaaaaa

SEQ ID NO: 915 - DNA, 2333 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgcc

SEQ ID NO: 916 - DNA, 4440 bp, Homo sapiens
ccctcccgctccccgcccccgcccccgcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaaaaaaaaaaaaaaa

SEQ ID NO: 917 - DNA, 8501 bp, Homo sapiens
ggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 918 - DNA, 895 bp, Homo sapiens
aaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaagcgaaaaaaaaaaaaaaaaaa

SEQ ID NO: 919 - DNA, 4834 bp, Homo sapiens
tacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccagtcctgcacagatgtgaagacacagatgaggtgtcgggccccagcttggcttcggcgtctatgtggacagctgctctctgaaaggttaatgagacctaatggtgttcaggcagtagtccggggcattttggaaggagcaggtgcgggagcagctggtggaagtgatgctgaggtgacggctgctgactggaagaagtgtgacctgatcgcaaagattttggcctcttgtccccagcagtctctttcaccagagaattactacagggacatctgcccccaggttctggatttatttcactttcaagataaattgacagcacgacaatttcagagagttgccaccactacctttataactttgtcaagagaacgcccacatttggcagcaaagtatttgctccagccagtgttagctcctcttcatcgatgtttgaatacagcagagctttcagagagtgacatggtaccaggaactattttggtgacagaagaagaacttagtagatgcattgaggatgtgtttaaggtgtacgtggttgggaatgaacctttaacagttttgatggattccctgcttccagtcctgggagtgctttttcttctctactgttttactaagcagagtgtgtctcacataaggtcactttgccaagaaatcttattatggattctggggaagctggaaaggaagaaggcaattgccagcctgaaaggatttgcagggttggacaaagctgtgccctctctccattctctgtgtcagtttagagttgccactcaaggtggcattatgattaccatcaaagaggccattagtgatgaagatgaagatgaagccctgtaccagaaggtatcctctgagcagggccgggtggagcatctcggggacttgctgtcccactgccaggaatgcggtttggcaggagacttcttcatcttctgtttgaaagagttgactcatgtggcctcggaaaatgaaacagagttaaaaactgagcccttctccagcaagagcctcttggaattagagcaacatcagactcttcttgtggaaggccaagagcggaagctgcttgtcctgcagctgatggctgttctgtgcgagagaatgtctgagcagatattcacaaacgtcactcaggtggtggactttgtagcagcaacattgcagagagcctgtgcaagcctggcccatcaggcagagagcaccgtggaatcacagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatggaaagaacagggctaaatctggtcctctggtgtcgagatggaaaactgtggagttgaagaggctctgatgcccagaaaggacaatcaagctggttgactcttccagagaagaagggtaagccctgtatttatcctcccaggccattcttcttcactcctgctgctgtttgcagagagttgccctgattatcaggagaaaagaaccacgagcatccagagagtttacatcctgccttctgtcctctgctccttcagaaagatgaatgcctagacaatgggttcacactgaatgcaggctggaaagaatgcatgctggtggcctaatgccagggctgttgaaacaatttcagatatagcactgtggtctccactttatttctttatatgttttggccgctgcattttgattgcagctaaaagagataacagaaaggagatactggctggctgcttcatattagccctctctgttgtcaacaccttgatgaggccaacccagagatgcttgatcagtcctcagctttgcagggctaggtacagaattttatcacaggattttatcacgctctctggggtgactagatccacaggaaccaaaacgcagtttccaaaagctcgagtgactgaaggatctatacacaaacatggctatttgctagttaacaacaggatatttctctctggccagatcacagacatggttctgagtcagatcttccttggtggcatccctttaaagaggccatcttatgaacaggatcacaagtgagcttagtgagcagagagttagaacaaatctagctaggtgtgtttaaggaatatttccattcagctagtgtagctggattaatttctattctccaaatcaaggatgtctagaaaatgggcattgtggctttcaaatctaagaagaatctcctttgggccagctggatgtacaataaaaatgcttgtttcttggccttcctttaaaaaaaaaaaaaaaaaa

SEQ ID NO: 920 - DNA, 3475 bp, Homo sapiens
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggttttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaaaaaaaaaa

SEQ ID NO: 921 - DNA, 2223 bp, Homo sapiens
acttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 922 - DNA, 3393 bp, Homo sapiens
cagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaaaaaaaaaaaaaaaaaaaaa

SEQ ID NO: 923 - DNA, 2618 bp, Homo sapiens
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaaaaaaaaaaaaaaaaaa

SEQ ID NO: 924 - DNA, 4049 bp, Homo sapiens
agcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctaggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggcaaaaaaaaaaaaaaaaaa

SEQ ID NO: 925 - DNA, 3408 bp, Homo sapiens
acatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcacttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaa

SEQ ID NO: 926 - DNA, 3780 bp, Homo sapiens
gtgctggggccaagcaggcattaaactctacccatcaagacaaaatgcctagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcccactggaaaaaaaaaaaaaaaaa

SEQ ID NO: 927 - DNA, 1963 bp, Homo sapiens
gaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggctctccgcctccttcttcccccgccggggcctggcgggctgggcggggcctggttcgctt

SEQ ID NO: 928 - DNA, 1291 bp, Homo sapiens
tggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacaggaccagccactagcgcagcctcgagcgatggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaaaaaaa

SEQ ID NO: 929 - DNA, 4099 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagcatgtgaaa

SEQ ID NO: 930 - DNA, 2117 bp, Homo sapiens
acttcggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattataaaaaaaaaaaaaaaaaaaaaaaaaaaaaaaaaaaaa

SEQ ID NO: 931 - DNA, 2543 bp, Homo sapiens
ggtgcggacgcatgcgtagtgggcttctcgggcggtggggtgggcgcggaatttggagacccacttcgggaaagtcaggatggtggtgccttcgctgaagcttcaggacctcatcgaagagattcgcggggccaagactcaggcccaggagcgggagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccatatt

SEQ ID NO: 932 - DNA, 10151 bp, Homo sapiens
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcc

SEQ ID NO: 933 - DNA, 1884 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggagggtaggtgggcaggcagcggggcatcgcctgggaatggaggcgctggcagggacagaaggcccctagtcccatgtgacctccagtaaagttttggcaccaaaaaaaaa

SEQ ID NO: 934 - DNA, 986 bp, Homo sapiens
ggcgaatctgctgctaccaatgtaaaggtcaggccgaggccggcgcggagaatctgctgtcgcctgcagctgctcgcctgtctccgtcggaagggagcccaagctttgcagagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcatgggaaaaaaaaaaaaaaaa

SEQ ID NO: 935 - DNA, 1031 bp, Homo sapiens
cgacagccggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggcaaaaaaaaaaaaaaaaaaaaaaaaaaaaaa

SEQ ID NO: 936 - DNA, 2422 bp, Homo sapiens
aagaggactgtcagaaggacgtagaaggcacggttttactgtgaggagcaaagattctttacctacgcattttacaagaaatgtgcagaaagccattgataaatatacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctaaaaaaaaaaaaaaaaaa

SEQ ID NO: 937 - DNA, 3715 bp, Homo sapiens
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 938 - DNA, 1119 bp, Homo sapiens
gacgcatttccggttcccttcgtttaggtcggctggaaattatgtcctccgtcggttttccgcagtttttccaccaagcgagatatttttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaaaaaaaa

SEQ ID NO: 939 - DNA, 4868 bp, Homo sapiens
agttagcgcctgctgggtgtctgctcgggtggtctgggaactacaattcccggcgggctgtgagatgccttggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgactattacagatttaaaaaaaaaaaaaaaaaaaa

SEQ ID NO: 940 - DNA, 4735 bp, Homo sapiens
ttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccacaaaaaaaaaaaaaaaaaaaaaaaaaaaaaaaaaaaaaaaaaaaaaaaaaaaaaaaaaaaaaaaa

SEQ ID NO: 941 - DNA, 3945 bp, Homo sapiens
gggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggggcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaaaaaaaaaaaaaaaaa

SEQ ID NO: 942 - DNA, 2317 bp, Homo sapiens
cggacgcgtgggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttaaaaaaaaaaaaaaaaaaaaaaaaaaaaaaa

SEQ ID NO: 943 - DNA, 1479 bp, Homo sapiens
aaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagtgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtaccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctccgccaggcaggaggccaggaggctgaggagctcctccaggaggggctcaagcccgtcctggaggaatgtgataactag

SEQ ID NO: 944 - DNA, 500 bp, Homo sapiens
cagcgccttgccttctcttaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacataaaaaaaaaaaaa

SEQ ID NO: 945 - DNA, 4490 bp, Homo sapiens
aaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgaaaaaaaaaaaaaaa

SEQ ID NO: 946 - DNA, 5156 bp, Homo sapiens
tgttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattcaccctaaaaaaaaaa

SEQ ID NO: 947 - DNA, 554 bp, Homo sapiens
atacagtgacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaagcttttgaagggtc

SEQ ID NO: 948 - DNA, 2689 bp, Homo sapiens
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgaaaaaaaaaaaaaaaaaa

SEQ ID NO: 949 - DNA, 553 bp, Homo sapiens
cgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaaaaaaaaaaaaa

SEQ ID NO: 950 - DNA, 1475 bp, Homo sapiens
aagagccgcgggagcgcggagcggccgctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctgaaaaaaaaaaaaaaaaaa

SEQ ID NO: 951 - DNA, 1506 bp, Homo sapiens
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 952 - DNA, 1691 bp, Homo sapiens
tacccccatccactcttctggcagggctggggaccttggggcaggtggtctccctccagaagagccctgtgttcagccagccctgtcctccagagcaagccccacaggtagcaagccccacaggtagcaaagtcagggagggtaatggcttagccccaggctcccaagctgggcagaacagggcagggagctggagagggtttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtcaaaaaaaaaaaaaaa

SEQ ID NO: 953 - DNA, 3198 bp, Homo sapiens
acctcgattgggggcggggcggcaatctgggtcttgtgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagtacattagatcctccggttctg

SEQ ID NO: 954 - DNA, 8533 bp, Homo sapiens
attcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattaaaaaaaaaaaaaaaaaaaaaaaaaaaaaaaaaaaaaaaaaaaaaaa

SEQ ID NO: 955 - DNA, 2501 bp, Homo sapiens
gtagtttcccgcccttgggggcgcggggacaaattccttgacccgaggaggatagggatgtggccttcggtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggagacttgatgtaattgtcttcacaattctgtgaagatggacttggtgtctctgcttcacatgaagggacctgaggttcagagaggctaagtaactttcctaggtcacagagctgtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttaaaaaaaa

SEQ ID NO: 956 - DNA, 1853 bp, Homo sapiens
cgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaaaaaaaaaa

SEQ ID NO: 957 - DNA, 2439 bp, Homo sapiens
gagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaaaaaaaaaaaaaaaaaa

SEQ ID NO: 958 - DNA, 3538 bp, Homo sapiens
gaatcattaacttaatttgactatctggtttgtggatgcgtttactctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctggaacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaatttttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgtatggggagtcatgcaaaccgattctgttattgggaatgaaatctgtcaccgactgcttgacttgagcccaggggacacggagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtcacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaa

SEQ ID NO: 959 - DNA, 3336 bp, Homo sapiens
agcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcaggctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaaaaaaaaaaaa

SEQ ID NO: 960 - DNA, 2987 bp, Homo sapiens
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagttaaaaaaaaaa

SEQ ID NO: 961 - DNA, 3725 bp, Homo sapiens
agcttctcggtgccgccccggaagtaacctctcgctgatctcgagagctagctcgagtatcgccctgccctggctgcgacgtcagctccgcccttataatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctcaaaaaaaaaaaaaaaaaagctgagacctgaagggtgagtagatgacaaacaggcagggtaaagggaagagcatcccaggcagagaggctagcatataatgaaggctctgagtaggaactgggaggaattgcttggaatgaaaaatgaagagggagtggctagatgaagactgcaggctggttaaggacttttgccctctggagaaggagctgagaagtgttttaagcagaaatttgactgcatgggagaagtatagagttgagaaaagtagtcctctgaggcttaagatagtgtcatctagactccagttccctcatcttgggtagcatagtagccccagcccaaaactgcaagcatgatccccgtctgggtttccttcacaagcactggagcatcttgtgctatgtgctgaactcaggtggataagaggttgaggcggttcccaaagctcctgctgcacccaggtgttgagcctaaatctgaaccttgtggagaggtcacaagaaagatccctaacagcactttggtttagtcagggctaggtgtcatcacctgtatgccctttggccaaggaaaccagaatttttcaggattttccccacctctggaaggctggaggaaggggaagacccactcagcagattcccatagtgcagggatcctcacaggcatgactttgccctttgtcatggatactgcagctcccagacagtcttctgggctttgatcagcctgcaatcatctgactagagcttgatttttggggcagggaaggtggtccttatatgagctgccacttaatgggccactggggatttttcaacatgaaaggtaccgagtctccaaatgctggttgtagggcctaaaaacagggctcaactccaggttctgccactttctagctgagtgatgagggctaacgtctggggagcaagatccctattttttcccattgtaaaattgggctaataaaagatgctacctactgactattaaataatatatgtaaagtggcaaaaaaaaaaaaaaaaaa

SEQ ID NO: 962 - DNA, 7884 bp, Homo sapiens
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaaaaaaaaaaaaaaaaaa

SEQ ID NO: 963 - DNA, 2298 bp, Homo sapiens
gagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctggtcttaacaaaagaaaaatgattcagcatgctgtatttaaagaacttgtgaagcttgtagaccctggagttaaggcatggacacccactaaaggaaaacaaaatgtgattatgtttgttggattgcaagggagtggtaaaacaacaacatgttcaaagctagcatattattaccagaggaaaggttggaagacctgtttaatatgtgcagacacattcagagcaggggcttttgaccaactaaaacagaatgctaccaaagcaagaattccattttatggaagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatacaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtggcgacatgtctaagaatgtgagccagtcacagatggcaaaattgaaccaacaaatggccaaaatgatggatcctagggttcttcatcacatgggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaaaaaaaaaaaaaaaaaaa

SEQ ID NO: 964 - DNA, 4157 bp, Homo sapiens
gaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgctaaaaaaaaaaaaaaaaaa

SEQ ID NO: 965 - DNA, 1460 bp, Homo sapiens
tgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacggtgatgtgggactacttcagccagctgagcaacaatgccaaggaggccgtggaacatctccagaaatctgaactcacccagcaactcaatgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcagcacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctc

SEQ ID NO: 966 - DNA, 4780 bp, Homo sapiens
gcagtcgccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaaaaaaaaaaaaa

SEQ ID NO: 967 - DNA, 3226 bp, Homo sapiens
aggaatggggcggggactaggccttcgcctcggcggcagaggagactcgggggccattttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggttttttatttttgtattttattattgtttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgctaaatggttttgtccttaaataggagaggctcaaaaacatcaagatttcaggaaaatggcgacagctgcataatggaacccccctgcttctattttgttcttttaattactatttatagccccagttaccttctgaattctgaagtgtatatacctccatgttcctgaaaacaagaaaactcttacttcctgatattccatagactgccttcccaggtgattgagaacatagagaatgttacacatttattttactctaaatgatcttttacccctgttagctaatctttgtgttttcctcaactttattaattacagtgattgcatttttagcatccagttgtaagatgaatatattaaacagctaccagtgttggtgatacctcatccttgaaaggcttagttcatttgtgttttatacttcagtttttccagcatagcagaaaatgccgcttataatttttgtgcacacaaaccttggattcccctgtaaagttgctattgtttcatagcatgcggcactggccttttttcatcctactcattacaggcaaaactcatgtcttatttatgaggattttatagatcattttctgtaacaggtgacaaaagcagaaaagaatgaagaggctgaagtatgaactacccttggagcccatatacatgatataggcaatttcttttgtatgttaattcagtcaaaaatactacccacttgatgttttctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaatggtatgtaaa

SEQ ID NO: 968 - DNA, 2667 bp, Homo sapiens
gtggggagttggctccgccctcctcccacgcccggttcccgtagccttagctctcggccccgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaaaaaaaaaaaaaaaa

SEQ ID NO: 969 - DNA, 3506 bp, Homo sapiens
ttcctcccctggactctttctgagctcagagccgccgcagccgggacaggagggcaggctttctccaaccatcatgctgcggagcatattacctgtacgccctggctccgggagcggcagtcgagtatcctctggtcaggcggcgcgggcggcgcctcagcggaagagcgggcctctgggccgcagtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 970 - DNA, 1514 bp, Homo sapiens
gatctggtaaacctgaagcaaatatagaaacctatagggcctgacttcctacataaagtaaggagggtaaaaatggaggctagaataagggttaaaattttgcttctagaacagagaaaatgatttttttcatatatatatgaatatatattatatatacacatatatacatatattcactatagtgtgtatacataaatatataatatatatattgttagtgtagtgtgtgtctgattatttacatgcatatagtatatacacttatgactttagtacccagacgtttttcatttgattaagcattcatttgtattgacacagctgaagtttactggagtttagctgaagtctaatgcaaaattaatagattgttgtcatcctcttaaggtcatagggagaacacacaaatgaaaacagtaaaagaaactgaaagtacagagaaatgttcagaaaatgaaaaccatgtgtttcctattaaaagccatgcatacaagcaatgtcttcagaaaacctagggtccaaggttaagccatatcccagctcagtaaagccaggagcatcctcatttcccaatggccctcctgttccctctactggcagccctagtgatgaccagctatagccctgttggatctctgggctgtgatctgcctcagaaccatggcctacttagcaggaacaccttggtgcttctgcaccaaatgaggagaatctcccctttcttgtgtctcaaggacagaagagacttcaggttcccccaggagatggtaaaagggagccagttgcagaaggcccatgtcatgtctgtcctccatgagatgctgcagcagatcttcagcctcttccacacagagcgctcctctgctgcctggaacatgaccctcctagaccaactccacactggacttcatcagcaactgcaacacctggagacctgcttgctgcaggtagtgggagaaggagaatctgctggggcaattagcagccctgcactgaccttgaggaggtacttccagggaatccgtgtctacctgaaagagaagaaatacagcgactgtgcctgggaagttgtcagaatggaaatcatgaaatccttgttcttatcaacaaacatgcaagaaagactgagaagtaaagatagagacctgggctcatcttgaaatgattctcattgattaatttgccatataacacttgcacatgtgactctggtcaattcaaaagactcttatttcggctttaatcacagaattgactgaattagttctgcaaatactttgtcggtatattaagccagtatatgttaaaaagacttaggttcaggggcatcagtccctaagatgttatttatttttactcatttatttattcttacattttatcatatttatactatttatattcttatataacaaatgtttgcctttacattgtattaagataacaaaacatgttcagctttccatttggttaaatattgtattttgttatttattaaattattttcaaac

SEQ ID NO: 971 - DNA, 5905 bp, Homo sapiens
ctcctcccgcaccgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaaaaaaaaaaaaaaaaaa

SEQ ID NO: 972 - DNA, 2445 bp, Homo sapiens
cagagacccttgacgggcatactgtttcctccgggctcctgcctcatgaggggagaggtgcggcttggctccaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccaccc

SEQ ID NO: 973 - DNA, 534 bp, Homo sapiens
cgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccaccca

SEQ ID NO: 974 - DNA, 1550 bp, Homo sapiens
ggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagtaaaaaaaaaaaaaaaaa

SEQ ID NO: 975 - DNA, 4625 bp, Homo sapiens
tgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 976 - DNA, 7972 bp, Homo sapiens
atttgaagtcctcgttccacgccttctcatcatcctgaacaccgagctctgggactccggcggagaatctaaacgtaaagcatcacccacggtcgtgaactgtaggctctcctggcatccgggatcttattctggccttggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcgaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaacttattaaaaaaaaaaaaaaaaaa

SEQ ID NO: 977 - DNA, 3705 bp, Homo sapiens
acggcgcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagagcttttgcctgtcagttgtgtgtgtcccttatagtcccttcccccacagctcttgctgaaagagtttgccttgttttgttttgttgttttgtatttagccagaggatgccaaaattagtcttctcaaagctttgagtagagtaagtgtgggaataagccagtttttttttttctgtttctgtaacttaaatgaacgggtttttttcccttgtatgccacttgtcctaacatgtccttaaggtgtttaacctgcctctgacctggcttgcaatgcataggtgaggagaagcagagagcttgtcatatgcaagtcctgtcaagaaaacaggtgggcatggtggctcaggtctgtagtctttgggtctttgggaggccagggtgggaggatcacttgagctcaggagtttgagaccagcctagacaacatactacgaccctgtctatacaaaaaaaaacttctctaaattagccggatgtggtggtgcatgcctgtagtcccagctactcgggaggctgagtgaggcaggaggatcacttgagaccaggaggttgtggctgtagtgagtgatgatcatgccactgcacttcagcctggaccacagagcaagaccctgtgtaaaaaaataaaataaaaaacagattggaaaaaaaaaaaaaaaaaaaaaaa

SEQ ID NO: 978 - DNA, 2056 bp, Homo sapiens
accgtattgttccgcgctcggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcaccttgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtgaaaaaaaaaaaaaaa

SEQ ID NO: 979 - DNA, 750 bp, Homo sapiens
acactatagaatcgtcgactctggaccttggctgtcactcagttgacacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttaaaaaaaaaaaaaaaaaaaaaaaaaaaaaaaaaaacgagcggccgctccctatagtgagtcgtattaagcttaattagctgagcttggactcctgttgatagatccagtaatgacctcagaa

SEQ ID NO: 980 - DNA, 1729 bp, Homo sapiens
gcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaacctcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttttgtcccccaacttgagatgtatgaaggcttttggtctccctgggagtgggtggaggcagccagggcttacctgtacactgacttgagaccagttgaataaaagtgcacaccttaaaaatgaaaaaaaaaaaaaaaaaaaaaaaaaaaaaaaaaaaaaaaaaaaaa

SEQ ID NO: 981 - DNA, 1862 bp, Homo sapiens
gtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcaaaaaaaaaaaaaaa

SEQ ID NO: 982 - DNA, 1762 bp, Homo sapiens
ggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaaaaaaaaaaaaaaaa

SEQ ID NO: 983 - DNA, 1278 bp, Homo sapiens
ccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaaaaaaaaaaaaaa

SEQ ID NO: 984 - DNA, 1864 bp, Homo sapiens
gcgcccggcgaaaccaccctcccgtgcagccgagcccagccgctctccggccgccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgccccccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccata

SEQ ID NO: 985 - DNA, 5777 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtaaaaaaaaaaaaaaa

SEQ ID NO: 986 - DNA, 1552 bp, Homo sapiens
aactgtcgtacgtatgtcttctgtttcgtcctcgctttccggctgctgtttctccacggctctcctctttccccctcccttctctcccgggcggcttactttgcggcagcgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaaaaaaaaaaaaaaa

SEQ ID NO: 987 - DNA, 1894 bp, Homo sapiens
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgccaaaaaaaaaaaaaaaaa

SEQ ID NO: 988 - DNA, 1643 bp, Homo sapiens
tttccgggacgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcagaaaaaaaaaa

SEQ ID NO: 989 - DNA, 839 bp, Homo sapiens
agacgttcttcgccgagagtcgtcggggtttcctgcttcaacagtgcttggacggaacccggcgctcgttccccaccccggccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggaaccagactgtgatgactgggagagcgggcagaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaa

SEQ ID NO: 990 - DNA, 1421 bp, Homo sapiens
gcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagttaaaaaaaaaaaaaaaaaaaaa

SEQ ID NO: 991 - DNA, 2909 bp, Homo sapiens
gcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagcggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccaggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaagggtgagcagattcctatgttggtgggcaccaatattccaagggcagctctctttgctgaatgagggccttctcgtgaggtactgacaacaccagcaactcgagagctgggaaactcaaggaggaggaagaaaatcaaaaccaccctactccctggggtgaggaaagaacaggaggggaggaggaggagtgtgctctgcacttgccttgctccagcatggggtggcagcagaggaatgtcacaggtcagcagcctaggcctccagctataaatagtccggagggcccgagaggctcccgcccgtccagcagggctgtcagcttcctgtgtggcagcacctggcacactggctctggccagcattatgctaaaaccctgttactctccaatgaaccagggaggcgggctcctctctgcgcctatcccttgagaattctgtcttaccagtgaagggtggggctgcccagatcaggcagcaggagtgaggggcacagtcaccccaggccttgctgagcccaggtctgggtactgagtgtccagagctgcctccccaggaggttaaggtgggggcaaaggggaagcttcaagcactttgcctacttttgttcactccccagtgcactgtgactcaggccttcccatcaggcctatttgtctacccaataaagcgtgttttttccagaaaaaaaaaaaaaaaaaaaaaaaaaaaaaaaaaaa

SEQ ID NO: 992 - DNA, 2710 bp, Homo sapiens
gctcatcttcctaccagaaatcggcaagtcactgaccctcgtcccgcccccgccattccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttagaatttgtgatagcattgataagttgaaaggaaaattaaatcaataaaggcctttgatacctttgttaaaaaaaaaaaaaaaaaaaaaaaaa

SEQ ID NO: 993 - DNA, 2418 bp, Homo sapiens
agcgggtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccttgatgaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcgccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattaaaaaaaaaaaaaaaa

SEQ ID NO: 994 - DNA, 2259 bp, Homo sapiens
ctcttgggttttttgtggcttccttcgttattggagccaggcctacacgccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgccgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaacaaaaaaaaaaaaaaa

SEQ ID NO: 995 - DNA, 2568 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtaaaaaaaaaaaaaaaaaaaaaaa

SEQ ID NO: 996 - DNA, 4750 bp, Homo sapiens
gagaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatcagaaaaaaaaaaaaaaaaaa

SEQ ID NO: 997 - DNA, 4520 bp, Homo sapiens
acagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaataaaaa

SEQ ID NO: 998 - DNA, 2732 bp, Homo sapiens
ctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagaaaaaaaaaaaaaaaa

SEQ ID NO: 999 - DNA, 3836 bp, Homo sapiens
actttgggtttcgaaatgttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaaaaaaaaaaaaaaaa

SEQ ID NO: 1000 - DNA, 1561 bp, Homo sapiens
gggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataataaaaaaaaaaaaaaa

SEQ ID NO: 1001 - DNA, 1507 bp, Homo sapiens
tgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaaaaaaaaaaaa

SEQ ID NO: 1002 - DNA, 2332 bp, Homo sapiens
gcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaaaaaaaaaaaaaaaaaaaaaaaaaaaaaa

SEQ ID NO: 1003 - DNA, 1851 bp, Homo sapiens
ggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaagtttgtaaaaaaaaaaaaaaaaaa

SEQ ID NO: 1004 - DNA, 1014 bp, Homo sapiens
gttattggttggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattaaaaaaaaaaaaaaaa

SEQ ID NO: 1005 - DNA, 972 bp, Homo sapiens
gattgcttatagaccggaagccgggaccttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaa

SEQ ID NO: 1006 - DNA, 866 bp, Homo sapiens
tcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaataaaaaaaaaaaaaaaaaaaaaaaaaaaaaa

SEQ ID NO: 1007 - DNA, 890 bp, Homo sapiens
tttcctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttc

SEQ ID NO: 1008 - DNA, 903 bp, Homo sapiens
agataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaa

SEQ ID NO: 1009 - DNA, 962 bp, Homo sapiens
cttcttttccgacaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaaaaaaa

SEQ ID NO: 1010 - DNA, 950 bp, Homo sapiens
tagacggcgcgccccgcccccgtacgcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaaaaaaaaaaaaaaaaaa

SEQ ID NO: 1011 - DNA, 5793 bp, Homo sapiens
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttaaaaaaaaaaaaaaaaaa

SEQ ID NO: 1012 - DNA, 6039 bp, Homo sapiens
tctcgcaggcagggctgggccgggcaggagctgcgaggccggcacaagggaggcggccctggggacctgacagggcgggggcgggggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcggaccctcccacgctgctcacgccctctaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccagtatgcgggtttacttacaaggaaaccttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaaattctttgagacagggtctctaatatgttgcccaagctgatctcaaactcgtggctcaactgattctcccgcttcaaccttgagtagctgggacgacagatacatgctactgcacccagctaggttaaggttctgtatactctgtctttctaaagcaattccctggaaattttctcaacattggttataactgaatgcttgggaagggaggggcagcccttcaacaggaaaaggggactgcccaaatcttaaatgcacagtcaagattctcttggagctagcaatggttctcaggttagtgagcatttagcttgcctgctgcagaatttgacccagatgggggtgttttttaggtctctcacaaatgagacaagcgaaacaattgtctccttttattctctttggtgcattggtgctggggaaacatgaactagcggcagtgtaactgcagaacatagacccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggttatttgccgttaaaaaaaaaaaaaaaaaaaa

SEQ ID NO: 1013 - DNA, 1173 bp, Homo sapiens
aagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacatttttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgaaaaaaaaaaaaaaaaaaaaa

SEQ ID NO: 1014 - DNA, 1052 bp, Homo sapiens
acctgcgggcgcagtggacccgaccgctccgctcgtccgctccctcccccgcgccgtgcacgtcttggttcgggccgggcataaaaggcttcgcggcccagggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtgaaaaaaaaaaaaaaa

SEQ ID NO: 1015 - DNA, 4182 bp, Homo sapiens
agacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaaaaaaaaaaaaaaaaa

SEQ ID NO: 1016 - DNA, 916 bp, Homo sapiens
agcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaatttgctccgtggcactgggaaaaaaaaaaaaaaaaaaaaaaaaaaaaaaaaaa

SEQ ID NO: 1017 - DNA, 2379 bp, Homo sapiens
ctcttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaatgaagataatttccttttctagaggtacatattaggccttttatgaacactaaaacaatgaggaaatgttggtcatggggc

SEQ ID NO: 1018 - DNA, 1286 bp, Homo sapiens
ctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgaaaaaaaaaaaa

SEQ ID NO: 1019 - DNA, 7062 bp, Homo sapiens
atctgcttaaaggggccgcgagcacttacctcccgccctgctccccgccgccccgccaccgcgtcttcagggctcccggcaactggctggaagggcttccctcaccctcagtaacagcctgccagcgaggagaggcgagccgggcgggaggcaaagaggaggcaccgcatttgtaaaaggcaagagagaaaggaaggaaggaaaaaaaaataacccgagcggcgcagagtggactctggtccgggagagcacgggcgggcgccggaacgtggacccagaggcaccggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagagatgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctaggtctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgta

SEQ ID NO: 1020 - DNA, 1635 bp, Homo sapiens
cattcaaccgccgctctgcgcggcgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaaaaaaaa

SEQ ID NO: 1021 - DNA, 1423 bp, Homo sapiens
catggcttccgaggagctgtacgaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggacggactccatgttaaagtacatgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagtaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagaga

SEQ ID NO: 1022 - DNA, 1268 bp, Homo sapiens
gccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttacaaaaaaaaaaaaaaaaaaaaaaaaaaaaa

SEQ ID NO: 1023 - DNA, 13671 bp, Homo sapiens
atgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcaaaaaaaaaaaaaaaaaaaaaaaaaaaa

SEQ ID NO: 1024 - DNA, 1419 bp, Homo sapiens
ctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttaaaaaaaaaa

SEQ ID NO: 1025 - DNA, 3758 bp, Homo sapiens
aagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtgattaaaaaaaaaaaaaaaaaaaa

SEQ ID NO: 1026 - DNA, 1650 bp, Homo sapiens
acaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtgaaaaaaaaaaaaaaaaaaaaaaaaaaaaaaaaaaaaaaaaaaaaa

SEQ ID NO: 1027 - DNA, 5415 bp, Homo sapiens
attggctaggccagggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctggttgtcattgtcttgattgcattcagtgtcaaaggagccaatttgacatccaggaagacatgatagctaaagggaaggcagtcagagaacccaggactggtgaggaaaggggtttgaatgtcggaattagaaggattgccctgtggcccagaaggatttagctcatcgtcgtcctgctagcctgccatctttcagactttccagggcaggtggcctggtcctcagccctcaacttgagttagtcacaccaaaatgcagtaaatgatgcccattttcctctgcctgtgcttgaccattttcactgacttttctccagttcaggaataacctgtgttccaatgggatggttctggggtttggcctcttaggaagtggggaatgggctgctgtggtatttacaggctagtagatcctttaggcagtaggctggaatgagtgctggggctgggacccagaaaggaaccagtagtggagtgggggtaatggcgttgcctgatactgccctatggttggaataaggaagggcagagaaaacttgaagcaggtatggggcattctggccatagagctcgtattttgcctgttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaagaaaagaaaaaaaaaa

SEQ ID NO: 1028 - DNA, 1343 bp, Homo sapiens
acatccggccgccggcactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaaaaaaaaaaaaaaa

SEQ ID NO: 1029 - DNA, 2142 bp, Homo sapiens
atggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaagcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctga

SEQ ID NO: 1030 - DNA, 4225 bp, Homo sapiens
gcagagggtgcggcccagaggaggccgcgggccgggaagggccgggcgggacgggaaacgttagggcagcggcccccggggtgagggggccgagcggacgggcagggccccgaggcgaactctgcccggatgaggaacaaagcagtggggcaggcgcgtgcgcccccagcgcagctggcaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaaaaaaaaaaaaaaaaaaaaaaaaaaaaaaaaaaaa

SEQ ID NO: 1031 - DNA, 5820 bp, Homo sapiens
cgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtaca

SEQ ID NO: 1032 - DNA, 6301 bp, Homo sapiens
aggaagtgactcaagaaacagtttgcgtgcgatgtggacaagagaggtccccgctgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagcggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgctcattgtaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaactgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccacgacctacttaggctacaatttcctttaaggcagcccctagctctgggaaggaatactggtagccagtggccagtgttcgctgtgggatcaccttctggccctccagcagcatgatggcacgctgtcgcccaaagacagcttgcaccacagcgctggggagagggatgaaggctcggcggcccagggcagcacccaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcctctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcctcaccttctctggcccttaggatctccccatttggagacagagccatttggatattttccccttgaacttctccatgacctgaagcgttccttccctggaggaactctggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttcaaaaaaaa

SEQ ID NO: 1033 - DNA, 3043 bp, Homo sapiens
ggtgccttaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggctaaaaaaaaaaaaaaaaaa

SEQ ID NO: 1034 - DNA, 2869 bp, Homo sapiens
cccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgaaaaaaaaa

SEQ ID NO: 1035 - DNA, 4819 bp, Homo sapiens
ctgtcaggtgactctcccgtggcgccatggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtagtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattagccaggcgtggtggtacatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgattta

SEQ ID NO: 1036 - DNA, 2725 bp, Homo sapiens
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaacaccatcatctaaattaatttaccatagactggccctgttcatacaggaatttgtatttggaaaaagttgatttgagaatcgattacatgcccttagaaaataggggtgtctaaaagacccaccctggtgtagactctttatgggaaaaaaggaaaaaaaatctcaaccattttaagataactgatggtttgtaaagttttcaatgcttagttatttaaagaaaatttaattaaaagataggaagtataaagtttgctaacatgttcaaagaactttaaaaaatgatcaaagatatataaacattattgtaattaataggtaaaa

SEQ ID NO: 1037 - DNA, 4473 bp, Homo sapiens
gtcccgtccgacgctagggggcgccgcaggctgcctggcgcgctgctcgcggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgtttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaacaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacatagcaa

SEQ ID NO: 1038 - DNA, 2043 bp, Homo sapiens
gtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtcatttgtgtatgc

SEQ ID NO: 1039 - DNA, 1765 bp, Homo sapiens
tcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagttaaaaaaaaaaaaaaaaaa

SEQ ID NO: 1040 - DNA, 1853 bp, Homo sapiens
gagggtctgtggtcctctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaaaaaaa

SEQ ID NO: 1041 - DNA, 2607 bp, Homo sapiens
aggaggaggggccggcagcctggaagggaaaggacagcggagagcagggcagagcctgagcaggcagggcacctccaggtgggcaggagctaccactcagcaccatgagcaccgccacaggcccagaagctgccccaaagccaagcgccaagtctatctatgagcagaggaagcgttactccacagttgttatggctgatgtatcccagtacccagtcaatcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcaaaaaaaaaaaaaaaaaaaaaaa

SEQ ID NO: 1042 - DNA, 2408 bp, Homo sapiens
ccgatccagcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactgataaaaaaaaaa

SEQ ID NO: 1043 - DNA, 1699 bp, Homo sapiens
agcgacgacttccgccctccttagggccgtggtcccgtagctaccggtcgcgtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgttcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtttcccaaaaaaaaaaa

SEQ ID NO: 1044 - DNA, 2072 bp, Homo sapiens
cgccgtgcccgcggagagagcgcggcgcgggaggccggcggccggccggctgcatggcgcgctgcgagaggctgcgcggagcggccctgcgcgacgtgctgggccgggcgcagggggtcctgttcgactgtgacggggtgctgtggaacggcgagcgcgccgtgccgggcgccccggagctgctggagcggctggcgcgggccggcaaggcggctctgtttgtgagcaacaacagccggcgcgcgcggcccgagctggccctgcgcttcgcgcgcctcggcttcggggggctgcgcgccgagcagctcttcagctccgcgctgtgcgccgcgcgcctgctgcgccagcgcctgcccgggcctccggacgcgccgggcgccgtgttcgtgctgggcggcgaggggctgcgcgccgagctgcgcgccgcggggctgcgcctggccggggacccgagcgcgggggacggcgcggccccgcgcgtgcgcgccgtgcttgtgggctacgacgagcacttctccttcgccaagctgagggaggcgtgcgcgcacctgcgcgaccccgagtgcctactcgtggccaccgaccgtgacccatggcacccgctgagcgacggcagccggacccctggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttaaaaaaaaaaaaaaaaaaaaaaaaaaaaaaaaaaaaaaaaaaaaaaaaaaaaaaaaaaaaaaaaaaa

SEQ ID NO: 1045 - DNA, 14895 bp, Homo sapiens
gtggcccgcggcatggagcgggcgtgattcatcagcatccgcgccggggcggcatgggggcgcgcgcggcggccgcctaggcgcccagggccaggcagcggcggcttccccggcccggctcgcccgcgcttctctccctgtgggcggcggcccggcgcctggaaggtcaagatggaagaaatcctgaggaagctgcagaaggaggcgtccgggagcaagtacaaagccatcaaggagagctgcacctgggccctggaaactctaggtggtctggataccattgtcaagatccctccacatgtactgagggagaaatgcctgctgcctctccagttggctttggaatccaagaatgtgaagctggcccaacatgctttggcagggatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttttactatgcatcacctacacgccaacatttgatctgaatgggagtgccgtgctgaagatcgcggaggtgtgcattgagacgtacataagcagctgtcaccagcgtagcataaacactgctgtgcgggcaactctcagtcaaatgctgagtgacttgactttacagttacgacagaggcaggagaatacgataattgaaaacccagatgtcccacaggatttcgggaatcaagggtcaacagtagagtccctctgtgatgatgttgtctctgtactcaccgtcctgtgtgagaagctgcaagccgccataaatgacagccagcagctgcagcttctctacctggagtgcatcctgtctgtgctcagcagctcctcctcctccatgcacctgcacaggcgcttcacggacctgatctggaaaaacctctgccctgctctcatcgtgatcttggggaatccaattcatgacaaaaccatcacctctgctcacaccagcagcaccagtaccagcctggagtcggactctgcgtctccgggagtgtctgaccacggccgaggatcaggctgctcctgcactgcgccggccctgagcggacctgtggctcggactatctattacatcgcagccgagctggtccggctggtggggtctgtggactccatgaagcccgtgctccagtccctctaccaccgagtgctgctctaccccccaccccagcaccgggtggaagccatcaaaataatgaaagagatacttgggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtgaggatggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatacatattcttgggtgtcataatcaagaaagaggtgacttctgttgtaaaataatccagaacacttcaaaattattcctaaatcattaagattttcaggtattcaccaatttccccatgtaaggtactgtgttgtacctttatttctgtatttctaaaagaagaaagttctttcctagcagggtttgaagtctgtggcttatcagcctgtgacacagagtacccagtgaaagtggctggtacgtagattgtcaagagacataagaccgaccagccaccctggctgttcttgtggtgtttgtttccatccccaaggcaaacaaggaaaggaaaggaaagaagaaaaggtgccttagtcctttgttgcacttccatttccatgccccacaattgtctgaacataaggtatagcatttggtttttaagaaaacaaaacattaagacgcaactcattttatatcaacacgcttggaggaaagggactcagggaagggagcagggagtgtggggtggggatggattatgatgaaatcattttcaatcttaaaatataatacaacaatcttgcaaaattatggtgtcagttacacaagctctagtctcaaaatgaaagtaatggagaaagacactgaaatttagaaaattttgtcgatttaaaatatttctcctatctaccaagtaaagttaccctatgtttgatgtctttgcattcagaccaatatttcaggtggatatttctaagtattactagaaaatacgtttgaaagctttatcttattatttacagtatttttatatttcttacattatcctaatgattgaaaactcctcaatcaagcttacttacacacattctacagagttatttaaggcatacattataatctcccagccccattcataatgaataagtcaccctttaaatataagacacaaattctacagtattgaaataaggatttaaaggggtatttgtaaactttgccctccttgagaaatatggaactaccttagaggttaagaggaaggcagtgttctgacttctttaggtgatctgaaaaaaacacccttatcatccagtgtaccatctagagatcaccacagaatccatttttttcccagttccacaaaacactctgtttgccttcagtttttactcactagacaataattcaagtttagaaacaggtaatcagctatttgatcttaaaaggcaatgaattgttgggatatcagtgaactatgttgtatacttttgaatttttacattttataaatggaattgaaagttggataactgctttttttaaattttccaacagaagtaacaccacagttgctttgtttctttttatagcttacctgaggttcagttcttctttgtgaacctgtgagtactccacagtttactgggggaaaaggcttcagtaaagcagaggctagaattacagtatttatacatagcaacttttcataaagtagaaaaattcaaaggaagctgtctcaatttgagaataccagctgggcacggtggctcacgcctgtaatcccagcacttactttgggaggccaaggtgggcagataacctgcggtcaggagtttgagaccaggctggacaacatggtgaaacctcgtctctactaaaaatacaaaaattagccaggtgtggtaggatgcacctgtaatcccagctacttaggaggccgagacaggagaatcgctcgaacccaggaggcggacgttgcagtgagccaagattgcaccattgcactccagactgggtgacaagagtgaaactccatctaaaaaaaaaaaaaaaaaaaagtgaatactgtatcccaaagtatgttagttgtttgtttggaaatcagcattctccccgatgctctattatgggatccaaaattcttgaacataagtttaccctgtactgtgtccaaacactgttctagttctagcctgattatgggtcccaagaataaaaggatgagtaggtgtacagagctcttgacctacaattttttaagagtgttttggtaccttcccattgtcttctctataactcagtcctaacatactctgcactcgagttaccagccatccacactgacatcagatttcaaccagaaccatcactgagtgacagcagtacttctcagaggtatttgcagcttgatgcaaagtagtctctaatgagtaggcattcaggtggttcttcccagcaggtggagaagaaagggaggagatgaagaacactgagaggggagtggcaccttcccaggctgcccagctcagtctcttgccctgttcctgtgactcagctgcccactcccccaactttgtttccctccctcccagtctctgaaagtgtcaggtgtttctctcctcacagtctcttttgcagcaacagtaagacaaaattcaaggcagccttttaaagttacgaacagttattagcatgtatttacagacctaagcagaatgagagtttatacattgtttttagttgcctgtatttatagccaaaagtatattaccttaaagttgagatctttctcttcttttcctaaattttggtaaagtgtgcttcatgaaacaaacatctggaaaactccaagtataagagaccctggactgatgatggcccagccaagtatatggagggacagagttctctctgtcattaatgaggacatcggttttcacaattgaacctcatgcactgtccacagcatctcacctagctcctgtatctcctgatctgcttttaaaaatagttagttaggctgcctttttacaccaccttctctctctccccttgtggtaattttccagccttccccatagatataaaactagaacacctttatgatttggggtctatgtaatgactgaccgataagaacccaggcagatgctaacatacttaacagctcgcattaaaatactttaaatcaggcgtgatggctcattcctgtaatctcaagcactttgggaggctaaggtgggtggatctcttgaggtcaggagttcgagaccaacctggccaacgtggtgaaaccccgtctctactaaaaatacaaaattagccgggcatggtggcagctgcctgtaatcccagctactcgggaagctgaggcaggagaattgcttgaacctgggaggtggggattgcagtcagccaagattgttctgcagcatgggtgacaaagtgagacttcgtctcaagtaaataaaactaaaatttttaaatcaaacatgacaaaaatgttaatataattcagaagtaccttgaaattgaaacatatttgtgcaatgatcattaggctttttgtccttgttgttttaaaatgaggcttatacagagtgagttgagagtcaagtagccttcgctgtgagacggtaatgcagttatataatagatacccttgactttgccagattcatcacaatactgcttatacaggaaagttttctcagaaaggaaaatccattagtatcagtcccatcaagccaaacagaatgaagacctttgatagtaatagcaagaggttacaaatagcagggaggaggcgagtagtgaatgtcactgtgattgcaaacccttacctgtattatcacacgtagtcctcacaacaaccttgtgagacaagtgttgtgttcctcattttttcagaggggaacacagacccagagaggttaagaaatttgcccaagataacaagtaaaaggcaaagttggttgcaaaagaggtgtttctgaattcaagggccatactctctctctgacaacatgctctaagtccatagagtaagcactctagtatgaaaaaaagtttcaaggaacgaggccatgaaaatgagactatttgacatctcagatctgtctgggatgttatggaggtttttaaaaataaagttgaaaaaagaaaatgaatcatgtttatacataaaaaaatcacatgtaacacatttcaagtgtttgaaaataaaaccaaaatctaaactttagtcttcaagcagacattcagtgttactttagaaaactcactgaattaggtggaaatgatggaataatactattcatggccagctattaacacagaagaacatggcagtgtgtgtctggaacggcatgcacaatttgtaaacctttttcaaatatcatttaatcaactcagaataaagtgccctgtagccaacagtgcctctttacttgcttctctgggaaatacatggtactaaattagtagcacaaagtttgggaatatgcaaaataatggataaccatttttcaaaatgtacattctctgaagaggaagcagctggttggacaggatttcttgaagagccaggtgctaagggcatcaggtcgacatccatagtaaccatgtgccataacatctacacatttccacttgttttacagacaaggtaacaggcagaaggaaaatccagagtcttgcagtaagcagatgacaaaacttcaatatgcttgggcaccacttaggtgaccccagggagatttagtgtggccttaggaaagcaaaagagcactttttattggaaatatgagcttgtcactgggaaagatttgtaaaattgatcaagaacttgatttataattatgcctcaaaaaaaaaagttctcatttagtagtggagcaatctagaaaacataccttttttgtttgtttggaagatcctctttccctggctgtattgtagtgtttgctatttgatgtggaaataactaataacttaagattttggaacagaacaccctttagatttccaaaacacaattcttatttcagggaagacagaccaaaaatatctcctgagatcattggtttctttataaattgtggtaccactccatcattgaagagaaaccactaccacaccactagcaccatacagaaccttttctctgtatctttgtacaatactacaaaggggtaccagggaggagagagtggctgaccactttagtgacaaaacagcactccactgctggtgaatcccatctaattatggtccttccacccttttcaaccaccaacaactgttcgtactgttaattcctatcctgaaggtttaaccagtggttgtctagtatcttctgtctttagaacagtggttctcaaactttagtacacatcagcatcacctggagggcctttttttaaaataagacacagattgctgggctcatggtcagagttcccagttaagtaaatcaggaaatttgtatttctaacaagtttataggtgaggccaatactgctgttttgggaactatgctttgagaaccactgccttgaaaaaatttccaacttctacctttaagatcagcctgacttatcaaacgctagagaaaaactgaatctacccttgggcagatgacttgggattggattctatacagcagtcttgctcaatcttcccagtttccagttttattataccaacaattggtttttacaagctagaagacaatgaatgtataagttctatggaacagtgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagccttggctcctggcttacagatttttgaatagttgtttgcttgccagttgttttacatctttcattggccaccaaaatattagccatttgagatgagatgagactacttgttgtaccttcatctttcatttaattttctggcgtaaattaacattttaatttcatatatatctgtaaagagtctacccaaaggcttcacggaaatttgcaaaatgaactaattcccttttaagcagcaggtgtgcctgtttttgacttttcagtaaatatgttgtttgtgcacatatctacatggtggagaccatattcattatttcatcttccaaataatgggaaaaatataaaagtgaatcagtgtgctttgggaattcagtgaaatcatgttaactcatatagagggggccttagtttatctcttctttactgaattaattagttttggaaattcttttaccattaaaaaaaattaaggaccatacagagaatgatttaagaaaaaacaagtcacttaaaaatcatcacctatttataaactgtattaattacacataatgcttattgattcaatgaggtttctctaaagacttctgcttaataaatatgctgacttcatttaaattagtttagactattgtaggaatggaaggaaatgattatatttactagaattagtgagatcagaaagcatatcagaatgttgatgatatcaaggagacaatctacagagtttttgcctctgtggatggaaataagggtgtttttttttggttttttttttactttagtttcccataatttttggaaattatgtgtgcatttagttcttttagtaacactgattttaaaattaaatttcaaaagtcaatctctaagagtaatttatttttgttttaccaaccagtgccaaaaaggagaggagggaatccaaaagccaatcttttgaaccaatgtgtaaaagattatgttttttcttaaagttagggaggctcgggccctgacactgccagccccagtgagcatccctggctacctcgggattatgtgcaagctgctttgtcctacatttctttcatctggttcttattgggagtgcttctctctaataaaaattgatttcccacaaaataggcaaagctgaacaaagatgaatgcttttgataagttgggtttcacttcagttgaaacaatgtgatagaatatccaggtgtggcatgatggggcaggaggaggtgcctagagggaaaagttatttttgtttcttagtgttgtgttgtggggatgggacagataagaataagatgtttattgccctaatcatgctaagagactattattcaatatgcttttcccgcttttctaagaggaataaacttagacaaattacattataaacagttcccctactactatctcccactctagataaagccagtgggtggtatgggtccttttattccttatagtattatgccaaagaatcaacttattttcattgaagattataaataaatgaagcttgttatagccataatgatttgagtcagtataccattttacctataaaatgcaaaattcatccttgcaaccccattcaccaggagccttgaagcattttgtttactccaaaggccttgtcaaggaagcataattttttgttttgccttcttatttagtcagtttggtcatatttacttaaaaaaacaaactgaaaatcacactcctttatatgttgatataactgattttatagaatctgtctgttctttgtttaacaggtctctgtaagcaagcttgcaagtgtattttgtgtacattttatctgaggtggaaatgaaaattctaaagagaaaatattttaaaagatattgtatttatgttgcttgtgttgtagaataaagattcaaatgcattaaaaatctggtacatgaaacaattgtgtttactgaataaatatatataaataaaaaaaaaaaaaa

SEQ ID NO: 1046 - DNA, 4221 bp, Homo sapiens
agcctcttcttcactggctcccgccctctttcagtcttggccctctcctccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacatga

SEQ ID NO: 1047 - DNA, 7817 bp, Homo sapiens
gaaagtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattcaaaaaaaaaaaaaaaaaaaaaaaaaaaaaa

SEQ ID NO: 1048 - DNA, 2466 bp, Homo sapiens
cctggccaccggctcgcggcgcgtggaggctgctcccagccgcgcccgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccggggccgagggcggcggggaccgcggtttgggagaccggccggcgcccaaggacaaatggagcaacttcgaccccaccggcctggagcgcgccgccaaggcggcgcgcgagctggagcactcgcgttacgccaaggaggccctgaatctggcgcagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcaaaaaaaaaaaaaaaaaaaaaaaaaaaaaaaaaa

SEQ ID NO: 1049 - DNA, 3540 bp, Homo sapiens
cagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 1050 - DNA, 3507 bp, Homo sapiens
tttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactgaaaaaa

SEQ ID NO: 1051 - DNA, 2055 bp, Homo sapiens
gggggcgggtccgcggctggccggccgggcgggcgccgacaatgagcctccataaaagggagcggcggggggcaggggccccggattgagccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaagaaaaaaaaaaaaaaaaaa

SEQ ID NO: 1052 - DNA, 3265 bp, Homo sapiens
ggctccgcgtccggcgcctgtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtacggcgcccttcgcgcgcgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgaaaaaaaaaa

SEQ ID NO: 1053 - DNA, 2019 bp, Homo sapiens
gggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagca

SEQ ID NO: 1054 - DNA, 2445 bp, Homo sapiens
ataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaa

SEQ ID NO: 1055 - DNA, 4674 bp, Homo sapiens
ctccttcccgctccgcgtcccgcccagcggcgcagggggccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaaaaaaaaaaaaaaaaaa

SEQ ID NO: 1056 - DNA, 4276 bp, Homo sapiens
tgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtg

SEQ ID NO: 1057 - protein, 482 aa, Human
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVGQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 1058 - protein, 647 aa, Human
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 1059 - protein, 586 aa, Human
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 1060 - protein, 126 aa, Human
MPEPTKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 1061 - protein, 372 aa, Human
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 1062 - protein, 341 aa, Human
MEREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 1063 - protein, 893 aa, Human
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 1064 - protein, 317 aa, Human
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 1065 - protein, 114 aa, Human
MASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 1066 - protein, 115 aa, Human
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 1067 - protein, 628 aa, Human
MEVSAAKAPSAADLSEIEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 1068 - protein, 437 aa, Human
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 1069 - protein, 231 aa, Human
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGLL

SEQ ID NO: 1070 - protein, 240 aa, Human [sequence omitted]

SEQ ID NO: 1071 - protein, 445 aa, Human
MMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 1072 - protein, 2328 aa, Human
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 1073 - protein, 408 aa, Human
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKEALKKIIEDQQESLNKWKSKGRRFKGKGKGNKAAQPGSGKGKVQFQGKKTKFASDDEHDEHDENGATGPVKRAREETDKEEPASKQQKTENGAGDQ

SEQ ID NO: 1074 - protein, 454 aa, Human
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 1075 - protein, 475 aa, Human [sequence omitted]

SEQ ID NO: 1076 - protein, 525 aa, Human
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRALQNTLLNKSF

SEQ ID NO: 1077 - protein, 466 aa, Human
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 1078 - protein, 732 aa, Human
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 1079 - protein, 1048 aa, Human
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 1080 - protein, 896 aa, Human
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 1081 - protein, 1001 aa, Human
MKRIFSCSSTQVAVERWNRHDQKLLEAVHRGDVGRVAALASRKSARPTKLDSNGQSPFHLAASKGLTECLTILLANGADINSKNEDGSTALHLATISCQPQCVKVLLQHGANEDAVDAENRSPLHWAASSGCASSVLLLCDHEAFLDVLDNDGRTPLMIASLGGHAAICSQLLQRGARVNVTDKNDKSALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGARGEPLGALGGEKALGGLAKGQLEKEMSVLRLSNSNLLEELGELGRERQRLQRELQSLSQRLQREFVPKPEAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 1082 - protein, 229 aa, Human
MNIRNAQPDDLMNMQHCNLLCLPENYQMKYYLYHGLSWPQLSYIAEDEDGKIVGYVLAKMEEEPDDVPHGHITSLAVKRSHRRLGLAQKLMDQASRAMIENFNAKYVSLHVRKSNRPALHLYSNTLNFQISEVEPKYYADGEDAYAMKRDLSQMADELRRQMDLKKGGYVVLGSRENQETQGSTLSDSEEACQQKNPATEESGSDSKEPKESVESTNVQDSSESSDSTS

SEQ ID NO: 1083 - protein, 1863 aa, Human
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 1084 - protein, 550 aa, Human
MKWEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 1085 - protein, 167 aa, Human
MGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 1086 - protein, 378 aa, Human
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 1087 - protein, 274 aa, Human
MASDSGNQGTLCTLEFAVQMTCQSCVDAVRKSLQGVAGVQDVEVHLEDQMVLVHTTLPSQEVQALLEGTGRQAVLKGMGSGQLQNLGAAVAILGGPGTVQGVVRFLQLTPERCLIEGTIDGLEPGLHGLHVHQYGDLTNNCNSCGNHFNPDGASHGGPQDSDRHRGDLGNVRADADGRAIFRMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 1088 - protein, 175 aa, Human
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 1089 - protein, 582 aa, Human
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIQVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 1090 - protein, 495 aa, Human
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEAPGLLERMVEALRAGSARLVAAPVATANPARCLALNVSLREWTARYGAAPAAPRCDALDGDAVVLLRARDLFNLSAPLARPVGTSLFLQTALRGWAVQLLDLTFAAARQPPLATAHARWKAEREGRARRAALLRALGIRLVSWEGGRLEWFGCNKETTRCFGTVVGDTPAYLYEERWTPPCCLRALRETARYVVGVLEAAGVRYWLEGGSLLGAARHGDIIPWDYDVDLGIYLEDVGNCEQLRGAEAGSVVDERGFVWEKAVEGDFFRVQYSESNHLHVDLWPFYPRNGVMTKDTWLDHRQDVEFPEHFLQPLVPLPFAGFVAQAPNNYRRFLELKFGPGVIENPQYPNPALLSLTGSG

SEQ ID NO: 1091 - protein, 621 aa, Human
MANVPWAEVCEKFQAALALSRVELHKNPEKEPYKSKYSARALLEEVKALLGPAPEDEDERPEAEDGPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDTPEAEGEVPELYHQRKGEIARCWIKYCLTLMQNAQLSMQDNIGELDLDKQSELRALRKKELDEEESIRKKAVQFGTGELCDAISAVEEKVSYLRPLDFEEARELFLLGQHYVFEAKEFFQIDGYVTDHIEVVQDHSALFKVLAFFETDMERRCKMHKRRIAMLEPLTVDLNPQYYLLVNRQIQFEIAHAYYDMMDLKVAIADRLRDPDSHIVKKINNLNKSALKYYQLFLDSLRDPNKVFPEHIGEDVLRPAMLAKFRVARLYGKIITADPKKELENLATSLEHYKFIVDYCEKHPEAAQEIEVELELSKEMVSLLPTKMERFRTKMALT

SEQ ID NO: 1092 - protein, 1359 aa, Human
MYSVEDLLISHGYKLSRDPPASREDNPKGRQAARTGTRAGQGLQNGHEDGPAALAHRKTSAGKGHVSDSESRRSTPRGHGEPQSTSASRTSEAGFCNQPPSAWSSHPPTGNDQAYRRRGRQEARSQKPREHENLEARGMAQAHSLPVHVREGPWEVGGRSEHVMKKPVWEEELRMSGPAKWQNVSLESWNQPRKLGRQMSDGDGERLFQDLYPFIQGEHVLNSQNKGKSRSLPRVLSPESLSCTEIPIPLNERHSPKMPPYPPTCAPNLDSTRNSEKSGCSAPFPRPKFGRPLKPPSYSSHQQSRGGADSSDSQDSQQMDAYVPRHELCLSDPGLEPPVYVPPPSYRSPPQNIPNPYLEDTVPINVCGGHSQQQSPTEKAGASGQPPSGPPGTGNEYGVSPRLPQGLPAHPRPVTAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRSGRGESKSESWSEELQPGHPRAWPPSPGRFRVEEGGGAPFCSADGSTSAEKRHLEVSNGMDELAGSPFPVTRMSSRSSDAKPLPASYPAEPREPQESPKITSAFSSVKPSEAVPRKFDSGGERGAGLPLSLSNKNRGLSAPDLRSVGLTPGQEQGASELEGSLGEASTIEIPPGESLQARAARILGIEVAVESLLPGIRRAGQNQPAEPDASACTPESPQEELLSRPAPADVPRVSTDAFYGRRKCGWTKSPLFVGDRDSARRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 1093 - protein, 584 aa, Human
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 1094 - protein, 129 aa, Human
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 1095 - protein, 954 aa, Human
MLSDYFLGLWSLAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQVRGQAFWLDAPPLELPFAHHSRYCVCVCMCMCVFRFFTVIKHTKRTTLTISRRGRWCYIHAVAGVQVGGVTHIHTVAGVQVGGVTHIWAVAGVQVSGVTHMLLQEYRSVVLHTFMLLQACRLVLLHTCCCRSTGRWCYMLLQACRSVVLHSRCCRRAGRCCYTHSCCCRSTGRWCYTCCCRCAGRWWYTHSCCCRSIGRWCYTHSRCCRRAGRCCYTHSCCCRSTGRWCYMLLQACRSVVTFTLLQACRLVLHTFTVAGVQVSGVTHSHLQACRSVVLHTCCCRRAGRWCYTHSLLQACRSVVLHIHAVAGVQVGGVTFTLLQTCRSVLLHTLLQACRLVVLHSHCCRRAGRWCYTHSFCCRRAGQCYTHSRCCRRAGRWCYTHSRCCRCAGRCCYIHAVASVQVGGVTFTLLLACRSVVLHTFTLLQTCRSVLLHTFMLLQACRSVVLHSHLQACRSVVLHTFMLLQACRSVVLHTFTLLQACRSVVLHSCCCRRAGQWCYTHSRCCRHAGRWCYTHSRFCRRAGRWSYIHTVAGVQVGGVTFTLLQACRLVLHTFTLAGVQVGGVTHMLLQACRSVVLHSHCCRRAGRWYTHSHCCRRAGRWCYTHSWCCRRAGRCYTHAVAGVQVGGTFMLL

SEQ ID NO: 1096 - protein, 878 aa, Human
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHGPAVDWWALGVCLFEFLTGIPPFNDETPQQVFQNILKRDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 1097 - protein, 545 aa, Human
MAEASSLGRQSPRVVSCLEHSLCPGEPGLQTTAVVSMGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 1098 - protein, 750 aa, Human
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 1099 - protein, 2039 aa, Human
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 1100 - protein, 445 aa, Human
MEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 1101 - protein, 521 aa, Human
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1102 - protein, 294 aa, Human
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKGGSLPKVEAKFINYVKNCFRMTDQEAIQDLWQWRKSL

SEQ ID NO: 1103 - protein, 254 aa, Human
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 1104 - protein, 311 aa, Human
MLTKPLQGPPAPPGTPTPPPGGKDREAFEAEYRLGPLLGKGGFGTVFAGHRLTDRLQVAIKVIPRNRVLGWSPLSDSVTCPLEVALLWKVGAGGGHPGVIRLLDWFETQEGFMLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVPLNPSKGGPAPLAWSLLP

SEQ ID NO: 1105 - protein, 661 aa, Human
MEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 1106 - protein, 411 aa, Human
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 1107 - protein, 361 aa, Human
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 1108 - protein, 2542 aa, Human
MVALSLKICVRHCNVVKTMQFEPSTAVYDACRVIRERVPEAQTGQASDYGLFLSDEDPRKGIWLEAGRTLDYYMLRNGDILEYKKKQRPQKIRMLDGSVKTVMVDDSKTVGELLVTICSRIGITNYEEYSLIQETIEEKKEEGTGTLKKDRTLLRDERKMEKLKAKLHTDDDLNWLDHSRTFREQGVDENETLLLRRKFFYSDQNVDSRDPVQLNLLYVQARDDILNGSHPVSFEKACEFGGFQAQIQFGPHVEHKHKPGFLDLKEFLPKEYIKQRGAEKRIFQEHKNCGEMSEIEAKVKYVKLARSLRTYGVSFFLVKEKMKGKNKLVPRLLGITKDSVMRVDEKTKEVLQEWPLTTVKRWAASPKSFTLDFGEYQESYYSVQTTEGEQISQLIAGYIDIILKKKQSKDRFGLEGDEESTMLEESVSPKKSTILQQQFNRTGKAEHGSVALPAVMRSGSSGPETFNVGSMPSPQQQVMVGQMHRGHMPPLTSAQQALMGTINTSMHAVQQAQDDLSELDSLPPLGQDMASRVWVQNKVDESKHEIHSQVDAITAGTASVVNLTAGDPADTDYTAVGCAITTISSNLTEMSKGVKLLAALMDDEVGSGEDLLRAARTLAGAVSDLLKAVQPTSGEPRQTVLTAAGSIGQASGDLLRQIGENETDERFQDVLMSLAKAVANAAAMLVLKAKNVAQVAEDTVLQNRVIAAATQCALSTSQLVACAKVVSPTISSPVCQEQLIEAGKLVDRSVENCVRACQAATTDSELLKQVSAAASVVSQALHDLLQHVRQFASRGEPIGRYDQATDTIMCVTESIFSSMGDAGEMVRQARVLAQATSDLVNAMRSDAEAEIDMENSKKLLAAAKLLADSTARMVEAAKGAAANPENEDQQQRLREAAEGLRVATNAAAQNAIKKKIVNRLEVAAKQAAAAATQTIAASQNAAVSNKNPAAQQQLVQSCKAVADHIPQLVQGVRGSQAQAEDLSAQLALIISSQNFLQPGSKMVSSAKAAVPTVSDQAAAMQLSQCAKNLATSLAELRTASQKAHEACGPMEIDSALNTVQTLKNELQDAKMAAVESQLKPLPGETLEKCAQDLGSTSKAVGSSMAQLLTCAAQGNEHYTGVAARETAQALKTLAQAARGVAASTTDPAAAHAMLDSARDVMEGSAMLIQEAKQALIAPGDAERQQRLAQVAKAVSHSLNNCVNCLPGQKDVDVALKSIGESSKKLLVDSLPPSTKPFQEAQSELNQAAADLNQSAGEVVHATRGQSGELAAASGKFSDDFDEFLDAGIEMAGQAQTKEDQIQVIGNLKNISMASSKLLLAAKSLSVDPGAPNAKNLLAAAARAVTESINQLITLCTQQAPGQKECDNALRELETVKGMLDNPNEPVSDLSYFDCIESVMENSKVLGESMAGISQNAKTGDLPAFGECVGIASKALCGLTEAAAQAAYLVGISDPNSQAGHQGLVDPIQFARANQAIQMACQNLVDPGSSPSQVLSAATIVAKHTSALCNACRIASSKTANPVAKRHFVQSAKEVANSTANLVKTIKALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 1109 - protein, 176 aa, Human
MAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 1110 - protein, 292 aa, Human
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 1111 - protein, 626 aa, Human
MIPANASARKGPEGKYPLHYLVWHNRHRELEKEVRAGQVDIEQLDPRGRTPLHLATTLGHLECARVLLAHGADVGRENRSGWTVLQEAVSTRDLELVQLVLRYRDYQRVVKRLAGIPVLLEKLRKAQDFYVEMKWEFTSWVPLVSKICPSDTYKVWKSGQNLRVDTTLLGFDHMTWQRGNRSFVFRGQDTSAVVMEIDHDRRVVYTETLALAGQDRELLLAAAQPTEEQVLSRLTAPVVTTQLDTKNISFERNKTGILGWRSEKTEMVNGYEAKVYGASNVELITRTRTEHLSEQHKGKVKGCKTPLQSFLGIAEQHGGPQNGTLITQTLSQANPTAITAEEYFNPNFELGNRDMGRPMELTTKTQKFKAKLWLCEEHPLSLCEQVAPIIDLMAVSNALFAKLRDFITLRLPPGFPVKIEIPIFHILNARITFGNLNGCDEPVPSVRGSPSSETPSPGSDSSSVSSSSSTTSCRGCEISPALFEAPRGYSMMGGQREAATRDDDDDLLQFAIQQSLLEAGSEYDQVTIWEALTNSKPGTHPMSYEGRRQDRSAPPTPQRQPAPPASVPSPRPSSGPGSGGHVFRSYDEQLRLAMELSAQEQEERRRRARQEEEELERILRLSLTEQ

SEQ ID NO: 1112 - protein, 955 aa, Human
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 1113 - protein, 243 aa, Human
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 1114 - protein, 659 aa, Human
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 1115 - protein, 172 aa, Human
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 1116 - protein, 319 aa, Human
MASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 1117 - protein, 860 aa, Human
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 1118 - protein, 113 aa, Human
MEDYQAAEETAFVVDEVSNIVKEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 1119 - protein, 164 aa, Human
MSVNMDELRHQVMINQFVLAAGCAADQAKQLLQAAHWQFETALSTFFQETNIPNSHHHHQMMCTPSNTPATPPNFPDALAMFSKLRASEGLQSSNSPMTAAACSPPANFSPFWASSPPSHQAPWIPPSSPTTFHHLHRPQPTWPPGAQQGGAQQKAMAAMDGQR

SEQ ID NO: 1120 - protein, 759 aa, Human
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 1121 - protein, 423 aa, Human
MGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 1122 - protein, 486 aa, Human
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYSRGFGGRYGVEKDKWDKAALGYDYKGETEKHESQRDYAKGFGGQYGIQKDRVDKSAVGFNEMEAPTTAYKKTTPIEAASSGTRGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVALYDYQGEGSDELSFDPDDVITDIEMVDEGWWRGRCHGHFGLFPANYVKLLE

SEQ ID NO: 1123 - protein, 573 aa, Human
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 1124 - protein, 282 aa, Human
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 1125 - protein, 2017 aa, Human
MTSRTKRRQKVKISISKINHSSYRKEHRPFWEHQPPPHQNWAVGGRCGAGARPGLSQRRGREVRREAQGGASSRRLRARLYFSESTSLPLDRRGSPGPLGPAPHGLRRAAPRGPARRTPRSTALTSRRRAQRPRHGDRLRLRSEARPRAAGDWPCARGGAVRPGRPHRPPRVESARGAHAGRAATDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYGYVLNESQSRQNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 1126 - protein, 753 aa, Human
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 1127 - protein, 1827 aa, Human
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 1128 - protein, 200 aa, Human
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSSSSLCEANDLPLCEAYGRLDLDTDSADGLSAPLLASPEPSAGPLQVAAPAHSHAGGPGPTEHA

SEQ ID NO: 1129 - protein, 270 aa, Human
MAASSSGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 1130 - protein, 323 aa, Human
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 1131 - protein, 194 aa, Human
MQAVRNAGSRFLRSWTWPQTAGRVVARTPAGTICTGARQLQDAAAKQKVEQNAAPSHTKFSIYPPIPGEESSLRWAGKKFEEIPIAHIKASHNNTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 1132 - protein, 328 aa, Human
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGQEKVIFPTLFMGQ

SEQ ID NO: 1133 - protein, 357 aa, Human
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 1134 - protein, 1020 aa, Human
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 1135 - protein, 1271 aa, Human
MEALRNPMPLGSSEEALGDLACSSLTGASRDLGTGAVASGTQEETSGPRGDPQQTPSLEKERHTPSRTGPGAAGRTLPRRSRSWERAPRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQNNTSPIIHSILLLVDKESAFRPDKDAIIQCEVVSSLKAVHKFVDSCQLTADLDGSFPYSHGDWICFRQRLEHFAANCEEAIIFLQNSFCSLNTHRTPRTAQEVAELIDQHETMMKLVLEDPLLVSLRLEGGTVLARLRREELGTEDSRDTLEAATSLYDRVDEEVHRLVLTSNNRLQQLEHLRELASLLEGNDQQSCQKGLQLAKENPQRTEEMVQDFRRGLSAVVSQAECREGELARWTRSSELCETVSSWMGPLDPEACPSSPVAECLRSCHQEATSVAAEAFPGAGVAVLKPHALGKPWASQQDLWLQYPQTRLRLEEALSEAAPDPSLPPLAQSPPKHERAQEAMRRHQKPPSFPSTDSGGGAWEPAQPLSGLPGRALLCGQDGETLRPGLCALWDPLSLLRGLPGAGATTAHLEDSSACSSEPTQTLASRPRKHPQKKMIKKTQSFEIPQPDSGPRDSCQPDHTSVFSKGLEVTSTVATEKKLPLWQHARSPPVTQSRSLSSPSGLHPAEEDGRQQVGSSRLRHIMAEMIATEREYIRCLGYVIDNYFPEMERMDLPQGLRGKHHVIFGNLEKLHDFHQQHFLRELERCQHCPLAVGRSFLRHEEQFGMYVIYSKNKPQSDALLSSHGNAFFKDKQRELGDKMDLASYLLRPVQRVAKYALLLQDLLKEASCGLAQGQELGELRAAEVVVCFQLRHGNDLLAMDAIRGCDVNLKEQGQLRCRDEFIVCCGRKKYLRHVFLFEDLILFSKTQKVEGSHDVYLYKQSFKTAEIGMTENVGDSGLRFEIWFRRRRKSQDTYILQASSAEVKSAWTDVIGRILWRQALKSRELRIQEMASMGIGNQPFMDVKPRDRTPDCAVISDRAPKCAVMSDRVPDSIVKGTESQMRGSTAVSSSDHAAPFKRPHSTISDSSTSSSSSQSSSILGSLGLLVSSSPAHPGLWSPAHSPWSSDIRACVEEDEPEPELETGTQAAVCEGAPAVLLSRTRQA

SEQ ID NO: 1136 - protein, 677 aa, Human
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 1137 - protein, 798 aa, Human
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 1138 - protein, 505 aa, Human
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 1139 - protein, 490 aa, Human
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 1140 - protein, 520 aa, Human
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 1141 - protein, 420 aa, Human
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 1142 - protein, 263 aa, Human
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 1143 - protein, 1505 aa, Human
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 1144 - protein, 403 aa, Human
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 1145 - protein, 134 aa, Human
MPADLSGTWTLLSSDNFEGYMLALGIDFATRKIAKLLKPQKVIEQNGDSFTIHTNSSLRNYFVKFKVGEEFDEDNRGLDNRKCKSLVIWDNDRLTCIQKGEKKNRGWTHWIEGDKLHLEMFCEGQVCKQTFQRA

SEQ ID NO: 1146 - protein, 217 aa, Human
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 1147 - protein, 668 aa, Human
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVTSS

SEQ ID NO: 1148 - protein, 664 aa, Human
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 1149 - protein, 1092 aa, Human
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRIFVGKSREERFCNENTPCPVPIFWASWGSWSKCSSNCGGGMQSRRRACENGNSCLGCGEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPGWSPWSEWSKCTDDGAQSRSRHCEELLPGSSACAGNSSQSRPCPYSEIPVILPASSMEEATDCAGKRNRTYLMLRSSQPSSTPLQSLDSFHILLQTAKLCWGPHCFEMGSISSTWWPRASPASWALGS

SEQ ID NO: 1150 - protein, 589 aa, Human
MYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTETMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 1151 - protein, 225 aa, Human
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 1152 - protein, 404 aa, Human
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 1153 - protein, 225 aa, Human
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 1154 - protein, 149 aa, Human
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKESKDPADETEAD

SEQ ID NO: 1155 - protein, 216 aa, Human
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 1156 - protein, 589 aa, Human
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEDDEDDNAGTEMKILRGHCGPVYSTRFLADSSGLLSCSEDMSIRYWDLGSFTNTVLYQGHAYPVWDLDISPYSLYFASGSHDRTARLWSFDRTYPLRIYAGHLADVDCVKFHPNSNYLATGSTDKTVRLWSAQQGNSVRLFTGHRGPVLSLAFSPNGKYLASAGEDQRLKLWDLASGTLYKELRGHTDNITSLTFSPDSGLIASASMDNSVRVWDIRNTYCSAPADGSSSELVGVYTGQMSNVLSVQFMACNLLLVTGITQENQEH

SEQ ID NO: 1157 - protein, 215 aa, Human
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 1158 - protein, 476 aa, Human
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 1159 - protein, 747 aa, Human
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 1160 - protein, 362 aa, Human
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 1161 - protein, 962 aa, Human
MNFLRGVMGGQSAGPQHTEAETIQKLCDRVASSTLLDDRRNAVRALKSLSKKYRLEVGIQAMEHLIHVLQTDRSDSEIIGYALDILYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 1162 - protein, 1318 aa, Human
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 1163 - protein, 1055 aa, Human
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 1164 - protein, 465 aa, Human
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKVDLQDGVLTPPPPPPPPPPAPEVLASAPPLPPSTAAPVGQGARQDDSSSSASPSVQGAPREVVDPSGGRATLLESIRQAGGIGKAKLRSVKERKLEKKKQKEQEQVRATSQGGDLMSDLFNKLVMRRKGISGKGPGAGEGPGGAFARVSDSIPPLPPPQQPQAEEDEDDWES

SEQ ID NO: 1165 - protein, 504 aa, Human
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 1166 - protein, 441 aa, Human
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTIHQACKLICRKCKRHVTDLTGQVVQEGTRRYRLCNECLAEFGIDSLPIDLEAEQHLMSPSDGDKDSRWHLSEDENRSYVEIVEDGSGDLVIQQVDDSEEEEEKEIKPNIR

SEQ ID NO: 1167 - protein, 327 aa, Human
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 1168 - protein, 822 aa, Human
MEEEEEAIGLLDKVLEDEDVFLLEECELGTPTSPGSGSPFLVAVKVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 1169 - protein, 662 aa, Human
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 1170 - protein, 179 aa, Human
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1171 - protein, 312 aa, Human
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 1172 - protein, 361 aa, Human
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKEGHTSTIQTLLSLGADINSKDEKNRSALHLACAGQHLACAKFLLQSGLKDSEDITGTLAQQLPRRADVLQGSGHSAMT

SEQ ID NO: 1173 - protein, 317 aa, Human [sequence omitted]

SEQ ID NO: 1174 - protein, 731 aa, Human
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 1175 - protein, 1044 aa, Human
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 1176 - protein, 511 aa, Human
MSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPSPTPVRSISTVNLSENSSVVIPPPDYLECLSMGAAADRRADSARTTSTFKAPASKPETAAPNDANGTAKPPFLSGENPFATVKLRPTVTNDRSAPIIR

SEQ ID NO: 1177 - protein, 428 aa, Human
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 1178 - protein, 801 aa, Human
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 1179 - protein, 304 aa, Human [sequence omitted]

SEQ ID NO: 1180 - protein, 223 aa, Human
MWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 1181 - protein, 285 aa, Human
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 1182 - protein, 224 aa, Human
MSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 1183 - protein, 1608 aa, Human
MYSAHRPLMPASSAASRGLGMFVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 1184 - protein, 602 aa, Human
MPSAKQRGSKGGHGAASPSEKGAHPSGGADDVAKKPPPAPQQPPPPPAPHPQQHPQQHPQNQAHGKGGHRGGGGGGGKSSSSSSASAAAAAAAASSSASCSRRLGRALNFLFYLALVAAAAFSGWCVHHVLEEVQQVRRSHQDFSRQREELGQGLQGVEQKVQSLQATFGTFESILRSSQHKQDLTEKAVKQGESEVSRISEVLQKLQNEILKDLSDGIHVVKDARERDFTSLENTVEERLTELTKSINDNIAIFTEVQKRSQKEINDMKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 1185 - protein, 1506 aa, Human
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 1186 - protein, 757 aa, Human
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 1187 - protein, 767 aa, Human
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 1188 - protein, 3298 aa, Human
MQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGRANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPSFSPSLSPLAARSPVVSPFGVAQGPSASALSAESGLEPPDDTELHI

SEQ ID NO: 1189 - protein, 1496 aa, Human
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 1190 - protein, 453 aa, Human
MLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 1191 - protein, 1537 aa, Human
MGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 1192 - protein, 523 aa, Human
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 1193 - protein, 314 aa, Human
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKKGDEVQCEIEELGVIINKVV

SEQ ID NO: 1194 - protein, 563 aa, Human
MSDDAGDTLATGDKAEVTEMPNSDSLPEDAEVHCDSAAVSHEPTPADPRGEGHENAAVQGAGAAAIGPPVQPQDANALEPPLNRDVTEDTLAECIDSVSLEAEPRSEIPLQEQNYPAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 1195 - protein, 356 aa, Human
MPEGEDFGPGKSWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 1196 - protein, 393 aa, Human
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQEELLADLHGTVAFKDFILSRGYRTPRFLENMYIGKECKRACNKTPIKRTQA

SEQ ID NO: 1197 - protein, 255 aa, Human
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSYYTCLKSQVVDLKAEGYWEELMDTTRPDIEVKDWFAARPDCGSKYQLCVQLLSSAHAPLGTFQPDPATIQQKSDAKWREVSHTFSNYPPGVRYIWFQHGGVDTHYWAGWYGPRVTNSSITIGPPLP

SEQ ID NO: 1198 - protein, 582 aa, Human
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 1199 - protein, 1017 aa, Human
MGKKSRAVPGRRPILQLSPPGPRGSTPGRDPEPEPDTEPDSTAAVPSQPAPSAATTTTTAVTAAAASDDSPSEDEQEAVQEVPRVVQNPPKPVMTTRPTAVKATGGLCLLGAYADSDDDDNDVSEKLAQSKETNGNQSTDIDSTLANFLAEIDAITAPQPAAPVGASAPPPTPPRPEPKEAATSTLSSSTSNGTDSTQTSGWQYDTQCSLAGVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRDHRRYFYVNEQSGESQWEFPDGEEEEEESQAQENRDETLAKQTLKDKTGTDSNSTESSETSTGSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 1200 - protein, 345 aa, Human
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 1201 - protein, 440 aa, Human
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 1202 - protein, 731 aa, Human
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 1203 - protein, 142 aa, Human
MVLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 1204 - protein, 142 aa, Human; identical to SEQ ID NO: 1203

SEQ ID NO: 1205 - protein, 166 aa, Human
MAPSTVAVELLSPKEKNRLRKPVVEKMRRDRINSSIEQLKLLLEQEFARHQPNSKLEKADILEMAVSYLKHSKAFVAAAGPKSLHQDYSEGYSWCLQEAVQFLTLHAASDTQMKLLYHFQRPPAAPAAPAKEPKAPGAAPPPALSAKATAAAAAAHQPACGLWRPW

SEQ ID NO: 1206 - protein, 999 aa, Human
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 1207 - protein, 390 aa, Human
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 1208 - protein, 1682 aa, Human
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLVRARRARGQRRRALGQAAGTGFGSPAAPFPEPPPAFSPQAPASTSR

SEQ ID NO: 1209 - protein, 1943 aa, Human
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 1210 - protein, 1249 aa, Human
MVEAAPPGPGPLRRTFLVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 1211 - protein, 1771 aa, Human
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 1212 - protein, 469 aa, Human
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINHRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRGKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 1213 - protein, 128 aa, Human
MMRFPLLSHKQGSKGGPLCSQNSKHETIAKGKTAKCFLAEFYFAFSFCHFSSCYRALRCTELQQTQGIQGYVEKPLTTVQGAEDINDVMSTQPALRILQEKNTEITPDRWYFLKMLYCKRVARVLQGL

SEQ ID NO: 1214 - protein, 323 aa, Human
MAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 1215 - protein, 135 aa, Human
MGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 1216 - protein, 281 aa, Human
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 1217 - protein, 248 aa, Human
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGIRETRRTVRDSDSGLEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 1218 - protein, 375 aa, Human
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKV

SEQ ID NO: 1219 - protein, 526 aa, Human
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 1220 - protein, 605 aa, Human
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 1221 - protein, 299 aa, Human
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 1222 - protein, 1375 aa, Human
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAGKSHEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGRNTSQPWNLRCNRDARRY

SEQ ID NO: 1223 - protein, 384 aa, Human
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 1224 - protein, 471 aa, Human
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 1225 - protein, 287 aa, Human
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 1226 - protein, 917 aa, Human
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 1227 - protein, 2115 aa, Human
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 1228 - protein, 259 aa, Human
MASPQGGQIAIAMRLRNQLQSVYKMDPLRNEEEVRVKIKDLNEHIVCCLCAGYFVDATTITECLHTFCKSCIVKYLQTSKYCPMCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSPLLLQYSVKEKRR

SEQ ID NO: 1229 - protein, 358 aa, Human
MAAVLKPVLLGLRDAPVHGSPTGPGAWTASKLGGIPDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEGPSPQFTLDFGNDASSAKDVDWTARLQDLRLQDAVLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 1230 - protein, 377 aa, Human
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 1231 - protein, 581 aa, Human
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 1232 - protein, 781 aa, Human
MAVAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 1233 - protein, 251 aa, Human
MVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 1234 - protein, 246 aa, Human
MAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 1235 - protein, 301 aa, Human
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 1236 - protein, 239 aa, Human
MAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 1237 - protein, 306 aa, Human
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 1238 - protein, 852 aa, Human
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 1239 - protein, 777 aa, Human [sequence omitted]

SEQ ID NO: 1240 - protein, 1738 aa, Human
MKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 1241 - protein, 519 aa, Human
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 1242 - protein, 744 aa, Human
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 1243 - protein, 1655 aa, Human
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLPLSGKKFDYRAFAALPSSRPVYDIQSPDFAEELRSLEPSPSPGPQEEDGEVALVLLGRPSPGAVGPEDVALCSSRRPVRPGRRGLGPVPS

SEQ ID NO: 1244 - protein, 115 aa, Human
MSRHSRLQRQVLSLYRDLLRAGRGKPGAEARVRAEFRQHAGLPRSDVLRIEYLYRRGRRQLQLLRSGHATAMGAFVRPRAPTGEPGGVGSQPDDGDSPRNPHDSTGAPETRPDGR

SEQ ID NO: 1245 - protein, 645 aa, Human
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 1246 - protein, 1211 aa, Human
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 1247 - protein, 707 aa, Human
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 1248 - protein, 93 aa, Human
MSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 1249 - protein, 144 aa, Human
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 1250 - protein, 1016 aa, Human
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 1251 - protein, 624 aa, Human
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGALTKVKESRRHVEEGKMEVQKADGIQDRCNTISFATLAEIHHFHQIRVRDFKSQMQHFLQQQIIFFQKVTQKLEEALHKYDSV

SEQ ID NO: 1252 - protein, 714 aa, Human
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRAVCTSCSIKMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 1253 - protein, 299 aa, Human
MAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 1254 - protein, 414 aa, Human
MIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPEDRATAEECLKHPWLTQSSIQEPSFRMEKALEEANALQEGHSVPEINSDTDKSETKESIVTEELIVVTSYTLGQCRQSEKEKMEQKAISKRFKFEEPLLQEIPGEFIY

SEQ ID NO: 1255 - protein, 885 aa, Human
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 1256 - protein, 108 aa, Human
MADPRVRQIKIKTGVVKRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 1257 - protein, 502 aa, Human
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 1258 - protein, 575 aa, Human
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 1259 - protein, 175 aa, Human
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKTSPCRSQVLPEAGAGEDSPGRNMDTALEELQLPPNAEGHVKQAMLFNVENGTPASREALWLSEE

SEQ ID NO: 1260 - protein, 447 aa, Human
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 1261 - protein, 245 aa, Human
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDQLYQQLEQNRRLTNELKLALNED

SEQ ID NO: 1262 - protein, 287 aa, Human
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 1263 - protein, 772 aa, Human
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVKYLGLDSIAVGGSRVDGARPCTPGSTARA

SEQ ID NO: 1264 - protein, 261 aa, Human
MAGDSEQTLQNHQQPNGGEPFLIGVSGGTASGKSSVCAKIVQLLGQNEVDYRQKQVVILSQDSFYRVLTSEQKAKALKGQFNFDHPDAFDNELILKTLKEITEGKTVQIPVYDFVSHSRKEETVTVYPADVVLFEGILAFYSQEVRDLFQMKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 1265 - protein, 322 aa, Human
KSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTASLWSPAMKEPLAKILCHRGGVRAVAVDSTGTYMATSGLDHQLKIFDLRGTYQPL

SEQ ID NO: 1266 - protein, 654 aa, Human
MERSGPSEVTGSDASGPDPQLAVTMGFTGFGKKARTFDLEAMFEQTRRTAVERSRKTLEAREKEEEMNREKELRRQNEDIEPTSSRSNVVRDCSKSSSRDTSSSESEQSSDSSDDELIGPPLPPKMVGKPVNFMEEDILGPLPPPLNEEEEEAEEEEEEEEEEENPVHKIPDSHEITLKHGTKTVSALGLDPSGARLVTGGYDYDVKFWDFAGMDASFKAFRSLQPCECHQIKSLQYSNTGDMILVVSGSSQAKVIDRDGFEVMECIKGDQYIVDMANTKGHTAMLHTGSWHPKIKGEFMTCSNDATVRTWEVENPKKQKSVFKPRTMQGKKVIPTTCTYSRDGNLIAAACQNGSIQIWDRNLTVHPKFHYKQAHDSGTDTSCVTFSYDGNVLASRGGDDSLKLWDIRQFNKPLFSASGLPTMFPMTDCCFSPDDKLIVTGTSIQRGCGSGKLVFFERRTFQRVYEIDITDASVVRCLWHPKLNQIMVGTGNGLAKVYYDPNKSQRGAKLCVVKTQRKAKQAETLTQDYIITPHALPMFREPRQRSTRKQLEKDRLDPLKSHKPEPPVAGPGRGGRVGTHGGTLSSYIVKNIALDKTDDSNPREAILRHAKAAEDSPYWVSPAYSKTQPKTMFAQVESDDEEAKNEPEWKKRKI

SEQ ID NO: 1267 - protein, 676 aa, Human
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 1268 - protein, 496 aa, Human
MELPSPESEEVHEPRLGELLGNPEGQSLGSSPSQDRGCKQVTVTHWKIQTGETAQVCTKSGRNHILNSDLLLLQRELIEGEANPCDICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 1269 - protein, 858 aa, Human
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKHQLKVHLLTHGGGQGRRPFKCPLEGCGWAFTTSYKLKRHLQSHDKLRPFGCPVGGCGKKFTTVYNLKAHMKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 1270 - protein, 632 aa, Human [sequence omitted]

SEQ ID NO: 1271 - protein, 350 aa, Human
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 1272 - protein, 369 aa, Human
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 1273 - protein, 560 aa, Human
MAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 1274 - protein, 319 aa, Human
MCSLPVPREPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 1275 - protein, 1211 aa, Human
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 1276 - protein, 797 aa, Human
MAHRCLRLWGRGGCWPRGLQQLLVPGGVGPGEQPCLRTLYRFVTTQARASRNSLLTDIIAAYQRFCSRPPKGFGKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRASEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 1277 - protein, 323 aa, Human
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 1278 - protein, 643 aa, Human
MPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 1279 - protein, 812 aa, Human
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQQNRMHPFRDDRRSKSIEEREEEYQRVRERIFAHDSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 1280 - protein, 962 aa, Human
MEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEEWFHQGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 1281 - protein, 308 aa, Human
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 1282 - protein, 213 aa, Human
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVPCTVTSASPLEEATLSELKTVLKSFLSQGQVLKLEAKTDPSILGGMIVRIGEKYVDMSVKTKIQKLGRAMREIV

SEQ ID NO: 1283 - protein, 145 aa, Human
MGCGGSRADAIEPRYYESWTRETESTWLTYTDSDAPPSAAAPDSGPEAGGLHSGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 1284 - protein, 575 aa, Human
MSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 1285 - protein, 202 aa, Human
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 1286 - protein, 353 aa, Human
MGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGEVSGPGGSEGSEPNGPGCESSPQPAQLSPQEGPCSCLR

SEQ ID NO: 1287 - protein, 492 aa, Human
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 1288 - protein, 201 aa, Human
MITETAAEPTVPAVPAAEEATEARGREEPAWPWKDAPIRTLVQRIHQLQAERAQGFRRLEEWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 1289 - protein, 171 aa, Human
MWTLKSSLVLLLCLTCSYAFMFSSLRQKTSEPQGKVPCGEHFRIRQNLPEHTQGWLGSKWLWLLFAVVPFVILQCQRDSEKNKEQSPPGLRGFPFRTPLKKNQNASLYKDCVFNTLNELEVELLKFVSEVQNLKGAMATGSGSNLKLRRSEMPADPYHVTICKIWGEESSS

SEQ ID NO: 1290 - protein, 205 aa, Human
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 1291 - protein, 306 aa, Human
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 1292 - protein, 729 aa, Human
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 1293 - protein, 2220 aa, Human
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 1294 - protein, 1602 aa, Human
MVDASGRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 1295 - protein, 474 aa, Human
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYIFRPSCTRLGQWAIGYVSSDGSILQTIPANKPLSQVLLEGQKDGFYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 1296 - protein, 224 aa, Human
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVLNARKLERDSLRDESQRKKEQDKLQRERDKLAKQERKEKEKKRTQRGERKR

SEQ ID NO: 1297 - protein, 70 aa, Human
MYFRFIPVKQQLELQVTPPRVLPTLGWPQIQLMPPPRRLVVPCSQQPVSSWSHSLFCISTLKRLRPRNVF

SEQ ID NO: 1298 - protein, 378 aa, Human
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 1299 - protein, 1054 aa, Human
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 1300 - protein, 219 aa, Human
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 1301 - protein, 975 aa, Human
MEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 1302 - protein, 228 aa, Human
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 1303 - protein, 264 aa, Human
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 1304 - protein, 265 aa, Human
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 1305 - protein, 153 aa, Human
MTSESTSPPVVPPLHSPKSPVWPTFPFHREGSRVWERGGVPPRDLPSPLPTKRTRTYSATARASAGPVFKGVCKQFSRSQGHGFITPENGSEDIFVHVSDIEGEYVPVEGDEVTYKMCPIPPKNQKFQAVEVVLTQLAPHTPHETWSGQVVGS

SEQ ID NO: 1306 - protein, 326 aa, Human
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 1307 - protein, 1143 aa, Human
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 1308 - protein, 285 aa, Human
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYHPVMCTECSTEVAVYDKDEVFHFFNVLASHS

SEQ ID NO: 1309 - protein, 670 aa, Human
MEEFRRSYSRLCRESGAEPQEAVLQQLHQLPRGRLDLATQSLTVETCRALGKLLPRETLCTELVLSDCMLSEEGATLLLRGLCANTVLRFLDLKGNNLRAAGAEALGKLLQQNKSIQSLTLEWNSLGTWDDAFATFCGGLAANGALQRLDLRNNQISHKGAEELALALKGNTTLQQLDLRWNNVGLLGGRALMNCLPSNRTLWRLDLAGNNIPGDVLRAVEQAMGHSQDRLTTFQENQARTHVLSKEVQHLREEKSKQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 1310 - protein, 257 aa, Human
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 1311 - protein, 258 aa, Human
MAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 1312 - protein, 570 aa, Human
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRPKSTPLSQPSANGVQTEGLDYDRLKQDILDEMRKELTKLKEELIDAIRQELSKSNTA

SEQ ID NO: 1313 - protein, 434 aa, Human
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1314 - protein, 650 aa, Human
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 1315 - protein, 144 aa, Human; identical to SEQ ID NO: 1249

SEQ ID NO: 1316 - protein, 138 aa, Human
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 1317 - protein, 697 aa, Human
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 1318 - protein, 112 aa, Human
MEAYEQVQKGPLKLKGVAELGVTKRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 1319 - protein, 875 aa, Human
MDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNIVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 1320 - protein, 269 aa, Human
DAWAVKEECRLLNAPPVPPRGGNGSGRLSSSPPVPPRFPKLQPVHSPSSSLSYYSSGLQDGAGSRSGSGSPSPDTYSLYCYPCTWGDCKEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 1321 - protein, 663 aa, Human
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 1322 - protein, 1219 aa, Human
MFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 1323 - protein, 432 aa, Human
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEVIKESKQEHKDVM

SEQ ID NO: 1324 - protein, 298 aa, Human
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 1325 - protein, 368 aa, Human
MCSLPRGFEPQAPEDLAQRSLVELREMLKRQERLLRNEKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 1326 - protein, 138 aa, Human
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDLVDSLLQVLNVKEGTPS

SEQ ID NO: 1327 - protein, 637 aa, Human
MDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 1328 - protein, 409 aa, Human
MADSSGRGAGKPATGPTNSSSAKKKDKRVQGGRVIESRYLQYEKKTTQKAPAGDGSQTRGKMSEGGRKSSLLQKSKDSSGVGKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 1329 - protein, 2035 aa, Human
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 1330 - protein, 1268 aa, Human
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKKKKTTTIAVEVKKSQHKYVIGPKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 1331 - protein, 355 aa, Human
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 1332 - protein, 732 aa, Human
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 1333 - protein, 803 aa, Human
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 1334 - protein, 641 aa, Human
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 1335 - protein, 205 aa, Human
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 1336 - protein, 480 aa, Human
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 1337 - protein, 483 aa, Human
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 1338 - protein, 557 aa, Human
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 1339 - protein, 392 aa, Human
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

(The sequence listing continues in the following parts.)

The invention claimed is:

1. A method for identifying markers for systemic lupus erythematosus (SLE), comprising:
   a) bringing serum samples of SLE patients into contact with more than 5000 antigens coupled to beads, measuring the binding of each individual antigen to autoantibodies in the serum samples of the SLE patients using an immunofluorescence assay, and determining the median fluorescence intensity (MFI) for each individual antigen;
   b) bringing serum samples of patients with rheumatoid arthritis (RA) into contact with the more than 5000 antigens coupled to beads, measuring the binding of each individual antigen to autoantibodies in the serum samples of the RA patients using said immunofluorescence assay, and determining from this—the median fluorescence intensity (MFI) for each individual antigen;
   c) bringing serum samples of healthy individuals into contact with the more than 5000 antigens coupled to beads, measuring the binding of each individual antigen to autoantibodies in the serum samples of the healthy individuals using said immunofluorescence assay, and determining the median fluorescence intensity (MFI) for each individual antigen;
   d) statistically evaluating the MFI for each individual antigen obtained from a), b), and c) using a univariate analysis and identifying marker candidate antigens with which SLE patients can be differentiated from RA patients and from healthy individuals;
   e) bringing serum samples of patients with early RA into contact with the marker candidate antigens identified in d) coupled to beads, measuring the binding of each individual marker candidate antigens to autoantibodies in the serum samples of patients with early RA using said immunofluorescence assay, and determining the median fluorescence intensity (MFI) for each individual marker candidate antigen;
   f) bringing serum samples of patients with systemic sclerosis (SSc) into contact with the marker candidate antigens identified in d) coupled to beads, measuring the binding of each marker candidate antigen to autoantibodies in the serum samples of SSc patients using said immunofluorescence assay, and determining the median fluorescence intensity (MFI) for each individual marker candidate antigen;
   g) bringing serum samples of patients with ankylosing spondylitis or Bekhterev's disease (SPA) into contact with the marker candidate antigens identified in d) coupled to beads, measuring the binding of each marker candidate antigen to autoantibodies in the serum samples of SPA patients using said immunofluorescence assay, and determining the median fluorescence intensity (MFI) for each individual marker candidate antigen;
   h) statistically evaluating the MFI for each individual marker candidate antigen obtained from e), f), and g) using an univariate analysis and identifying a marker for SLE when a threshold value of 3 standard deviations above the mean value of the healthy samples is not reached; and
   i) identifying a SLE patient for stratification and administering at least one therapeutic agent to the SLE patient for treatment or monitoring the SLE patient for control of the SLE patient's therapy;
      wherein the marker for SLE is selected from the sequences of SEQ ID NO: 1-11, 13, 15, 16, 18, 19, 20-24, 28, 29, 31, 46, 61, 95, 126, 128, 134, 136, 143, 152, 163, 169, 171, 173, 188, 191, 213, 214, 241, 258, 270, 302, 348, 349, 367-370, 372-375, 378-391, 403, 406, 408, 415, and 423-433.

2. The method of claim 1 for identifying markers for SLE, comprising selecting a marker for SLE which, in the univariate analysis, has an adjusted p-value for the non-parametric mean value comparison between the groups of less than 0.05 and at the same time have a fold change of greater than 1.5 and an AUC resulting from the ROC analysis of greater than 0.75.

3. The method of claim 1, wherein the marker for SLE is selected from proteins encoded by SEQ ID NO: 1-11, 13, 15, 16, 18, 19, 20-24, 28, 29, 31, 46, 61, 95, 126, 128, 134, 136, 143, 152, 163, 169, 171, 173, 188, 191, 213, 214, 241, 258, 270, 302, 348, 349, 367-370, 372-375, 378-391, 403, 406, 408, 415, and 423-433.

4. The method of claim 2, wherein the marker for SLE is selected from proteins encoded by SEQ ID NO: 1-11, 13, 15, 16, 18, 19, 20-24, 28, 29, 31, 46, 61, 95, 126, 128, 134, 136, 143, 152, 163, 169, 171, 173, 188, 191, 213, 214, 241, 258, 270, 302, 348, 349, 367-370, 372-375, 378-391, 403, 406, 408, 415, and 423-433.

* * * * *

UNITED STATES PATENT AND TRADEMARK OFFICE
CERTIFICATE OF CORRECTION

Page 1 of 1

PATENT NO. : 10,746,735 B2
APPLICATION NO. : 15/117508
DATED : August 18, 2020
INVENTOR(S) : Angelika Lüking et al.

It is certified that error appears in the above-identified patent and that said Letters Patent is hereby corrected as shown below:

On the Title Page

Item (30), in the Foreign Application Priority Data:
Line 1, "14154557" should read --14154557.4--; and
Line 2, "14178090" should read --14178090.8--.

In the Claims

In Claim 1, Column 87, Line 29, "from this—the median" should read --from this the median--.

In Claim 1, Column 88, Line 26, "an univariate analysis" should read --a univariate analysis--.

In Claim 1, Column 88, Line 30, "a SLE patient" should read --an SLE patient--.

In Claim 2, Column 88, Line 44, "have a fold change" should read --has a fold change--.

Signed and Sealed this
Second Day of February, 2021

Drew Hirshfeld
*Performing the Functions and Duties of the
Under Secretary of Commerce for Intellectual Property and
Director of the United States Patent and Trademark Office*